United States Patent 10,221,454 (METHODS AND COMPOSITIONS FOR SCREENING AND TREATING DEVELOPMENTAL DISORDERS) - sequence listing, part 3

SEQ ID NO: 80 - DNA, 1402429 bp, Homo sapiens
tataatctggagagacagaggagttgagagtgcccctttaaactgcaggactgcaattgatctctgtatgttttctggttttcgtccctttgaaaggggaatgagagccaggatcattggctgtactgtggagctgtcacatctccatactgaaaaggtacactgcaagtgaatttaaaccgtttttggctttctattgcatattgccaagagctttgagactgatgaaccaagtaaatgctctatttagggctaagtgagatacagattcctccaatctgatagcgtttcagcctccggagtgaggaagcagcagaaacagaagcagcagaagcaacagcagtagcagcggcagcagcaacagcagcagcccctactgaagtccaatagaggagacttgatctctagttcattctggaactccgcctgggattgtgcactgtccagggtcctgaaacatgaaccaaactgccagcgtgtcccatcacatcaagtgtcaaccctcaaaaacaatcaaggtaggatctggtttttccctctgcttctgcacatgtgtcttcattcatctacctaacacatgggcattgatatatcggggtactgacagtggacatacctacttgatttgagtttgaattgaaggttgagtcacaataaagcatttggctctgcatgtgtgtgtagactggaaagaatagtttccactgaacacttctttcatcttcatgactttttttttttttactgagaatctatcagaggtatatttccagaagaaagttttgtgagtgtctagaagagtttccagtccatgccaattttcttgatagaactggggaagaatttgcaaactgctagaaataaatagcatcaaattgactacaaatctgataacaggatttcattgtcatatgaattttggatctcttatccttttttaaaaaaagctcatccttcattgtgagcattgaactggtggttatactaaagtgattatagtgagagaggatgaaagactagagagagagtataaaatcacatgtctttatttatatcaccatgtaactcaaaaccagtgagatgattggagacactcttcaatgcaggtgttgtttaaaatttgaggcttttctgacagcacatggttaaaggtaaagaacaaactcacaatttcactcttctgttttagtttcaagtcatgcttataccattctctttgtttttattcgggatgctcttatttccaagaaggcttataaacgaccagacttccaatcaaagtttactatattttgccatttacttgaattgtattattatctatgtggatattttgcatcttgagggaaagtgatggattcgtctgaaactcttttatgaaaaaaaaaaaaaaactaaaacaaaaaacgtgatatcctgacagggcatctttagttactgcaatctctcattaacatacaagtgcataccttttgctactattcctgataagcctgactttttatgatttatattatgttttggtttatgtctcaggcctttaataatattgcatagactgtaattacaaaaggaatataattttcaacaatgtctcttcttcatgaatttacctaccgtttgccagagtgtttcagtgatagataaaccataaactaaacatgttcctctatttattagcagtgacttttaaaagcaatggggtttccagggtatattaaatgatgcataattagattcccatcatacataaacatagggagttaactgaaatcatgcagaactcatattcagataatttacaccacctctaataacagatatgagaatctttttcagcattagattttctgtgctgtatctaagtttagaaataaaaaatgttgagcttttggtatagttttcctctgtgtatcagtttcccacatacatcaattatctaagcatatcactgaacaaagccaaaatagtaaatacatgacactctacattgggatatataagctctagtgggaaatatgtattgaagcctaaagtgggatagagttacaaactggctgcctactgctaagtatgtctagaatgctataacaaaaccagtggctttctgtttaagagtctgaggtcacaggaatcaagcatttattttcccttttctttattgagtaagcataaatgactactactttcagagacttcaaatcacttcctttattagtgctctggcattggctgcccacaaacaaactgtggaacagaaaaaaaaatgtttctagtgtagaggttttacatcatcttgctgatcttgcagatgctgttttttccttctaactgcagccattgagttgaaatgaaaagtatcataaaaattggacaacccaccacttaacaatgtattatattaatggcttaatgaaggaatcttgaatcaaagctctgggtaatttggttaattgtacaagttaaattcttttgtgcaccccattcccaatattgctctggggagcaaaaaaatgcttgtgatgttcataaaatatatatagtcgcaagcactgaactattaagggagtaattacttgagtattttgcaatttgcaatagtgaaaagggatgagtggaaaatctctcttagttcaaattatgtgctcaattatgaaacatttatggctttttgaatttatactaaaaatggctatctatatttaggtaatgcattagcctatgaacaaaatgcaataacaatctaaagaaaaactctaagatgagagggttttgggaagctgtgggacattggagctcaaaatactctttgaactattagaattttagtttcaagcatggttgtttaaagttaattttattcctcactcttaaatttactatcaatttactatcagataattttaagtaaccctccctcatggaatctggttggcctgcaggtaatgataacccactttgaggatctggaaataaataacttgcatattgctccattttagaaattcaaaaacctctagagacttttctcccaaagctcagtgtaataacctctagagaacttttcccccatcagtatagtaaatgctgactgtttcttctctcaacagttaaactacggctaaaaagaatgcaatgggaatgaacaaaagtgaaatgcattgctaaaatagctgtaaaggccaaaagtgtgcaggaggaggaaaaacagctctgtgtgtgtgtgtgtgtgtgtgtgtgtgtgtgtgtgtgtgtgtgtgttctcctccacttgaagttcaagaagtgatgaagtctatagtgggtaaaattcagcaattgttgccagtgaaggctgtttgtggccatgatgtgtcagagttggaaaagaggaaattgggagaagttataatggaacaagatgatcaagagtattcaggttgcttgacacttgctttggtcgttctggccattctttagctcagacagttactgacacacttttcctggcatactttggcaggtatgttcctatcgtcaaaaccagtaagggagagaaaagggagtcaaataggggtgccaagtgtgttctcagatcactttgggtgaaatgctgaatgcaattcactctgaaaactttcctccatttcagagcttgtaagggaagaaagcttttcctgatgtgattacaaatcttcctgtgaaggtagcaacattcttttaaaaaaaatcttttactctgagatgtttaatggaaagttttaggaagtatctgggaatgctaaatagagatcagatctttgcgttattataaacgtgatttctgaagaatgtcccccaccatgggtagcaaacttgagtttttccttcaccattatggcttctcttggctgcactgaaagtaaattaaacctttcagctaaatctctgatcttggtttacttcttttgctagtggaattgcaaacttagaattttgcctctaaaatgtgcagatttttttcttatttctttcacatttgaatatcagtctagtatcctcgtgtgtctaaaatgagtagagaaaatccttcatcctttttgaagttataaattgtgagtaacttatctggggtggtgattcctggatcaagaattatatgtattatactttatatggtaactctgaaatacagtacacaatatttctttacccttcccatgtagtgaccggtcttcctctttctctttcctttttacaagacctgcctgatttattttaatactgccttcacacccaggttttcacttccatttagaaaagagtctcaaggtctaaaagttctagttacttcctacatagccctgctgcaagtttttacaaactatacttaaacgaatctttaagattttcattgtcttcggagtacatcttgagctggcaaactttttcatggtgatttttactgccttttatattgtaatattgatgagtcattgtgctaataaagacttttcccccttgctacttctaatccatagcctcagccaaatgaggcataggaaacagaagacaaggggttaaaagaggatgaaaatcttatcacaagtatgtattgttaaatacgtaggcttggaacatggtggttaggaaataatttcgttagcaaattggtattttggagtgtgacattgccatgaattggcatgatgagatggcttggaactacagcattgcaatctcactggttgttaaattttttttttttttttttgagacggagtctcagctcactgcaacctccgcctcccagtttcaagtgattctcctgcctcagcctcccgagtagctgggactacaggcacctgccaccacgcctggctaatttttgtatttttagtagagacggggtttcaccacattggccagcatggtctcgatctcttgacctcattatccacccctctcagcctcccaaagtgctgggattacaggcatgagccaccgcgcccggcccacttgttgttaattctatacccctaacctaaatgctggacactgacaaacctgcgtttcacatagtacttgaacttgaattgtaagttattcttaaagggtatttcataattaaatatataaattatatccacaaaaatttagaaatgcaaggaatgtttaataacaaaaaatctacctctgtgtgtcattgcaatatgcaaaatggaagattctccaatgtcattattacagtatatgaaattctaagtggaaagattgttacatacttctacattgtaccttatcttagagagtcttcctattcctaatcctaagaactttactcataagaatacataaaaagaaactttataaaattatcgactcaacatagattcatacacactaaagaaagagttaccactggtaactctacagcaactgatttcaccagtgagttctacacttccatttagcaaggtacagatttttcttcagcattaggatgagtcattctaagcggtgatagctaaggaaatcaaaagaaaaaacttacaaaaattagaaataaggatattttatgtgtgtgagagaaaacttttttctcttagcaatggtctacatatttttaattactctgacacagcttccttatatgcttaaggcaaaatcacagcctgtgataaacaagaataggaccatctgctaatgacaaatttatcaccacttacaatttccatttatggccaagtatttaaatcttaaataattatagcacaatttatttcaaattactataaattcagctgtttttaaaatgaagcattatagttttttttctttttaataaagagtgactataataattggccagctttacattttatagcttagatcttcataaaatcaaaagtttctttttcctttgacatttatagtgtttgaatgtcaacttttactttgaagaagtattcttgtataatataatttcaaggtaaatttaaacagttttatgaagtatttagtatttattttattcttgagaaagtaatgtgttaatacttttctagaaattcatgttttggtcagttagtgaagacattcttgatggtaaatttgtgatgacaaattactaactctcactgaaaagacattatgggtctacaaatgaagcatggacgtagtaagctaagatagtggttatcaaagtgctgtccctagaccagcagtatcagcatctcctgtgaactcattaaaaatgcaaattcttggactctacttagacctactaagtcagaaactcttggggtagggcccagcaatctttggtgggtgattctgatccatattgatgttttggaaccactgagctaaagaattacaaaataagacacatctgtgctattgtcagcctgtaagaattgtctgagtaccacagaagaggtctaaacagcttcagaatgatacttagggttattaagtaacatgaattctgtgacagccaaaatctcatcattaggtttatctcttttattcctcacagggattacttgatactatgcctttcacccagtagacattaaatatatatttgttggttattaatgactgttaaggtcatttagtagagataatgctctaagaggacctaaatgatattgtaaggtgttactcaacatgtaagcaggttagaggccttgctttttgttttaaattcatagaaaatttctcaaagaagtatactgacattttggcttttgatggttttgttctctgatcttggtttggggccatctggtaatcaacacattttggtaactagggggatttagaatcatactaattttttgtccagaaattgtgctggagaaatgtctcccttcttgccagctgtatctgaaaattggcaaacaatggtagggaggaatatcatcacattagcctttctccttgcctttatgaatgttctttggcccgtagatatgtgccaggttggtagggcataactggaagtagcacacaactggaacaacatgaataattgtgaacaaagctggccttccacggacagacacagcataatattacattagcagaacaagatttaagctgggggataagctgtgaaataaggaaattacctccaaacaggcttatttcttggaaattcttcatagcactctgatgtttttctttttttttttttttatagttaccactgggaagaaaagtaaaatgcatacagcctgccctactacctgcaaacggatataaggcagatcggatggctttttctttagaggggcatccttaagtggagttctcactctccctttaccacatgaaccatgtggtcttgcggaaggcaattaaccctgttaaggatttctcccccactaacagaagggcaataaacttaaattatctgcccaaacaaaaatgctatgtaagtgctttgtattatgatttgttctagtagcaatttttaaggatacgacattttcataaggagttgtatagtgagaatcaatttttatgacataaaagctgagaattttatttgcaattattattaactataatgatgataaaaattcattttgaagtcacccgggggatgaaaattatcttctaatattgtagtaacatctgcaagatttcatcatgaacctttaccagggaggtaggggaagaagattggattcaaatgtcattgaaagaactgattaattcagtaaaaaaatgcagttagtcatcccagtgctgtgctaccaaaatggaaaatacctgggtagctgcattgatggtacatatggttgcattgaggaggaattgtatcatggaataaatataggcttcatatgatctctgtgcttctagacttgatacttcctttgcctcacataccttccccatcccccaaaccccaaaaatggttcttttagcaaactcctattcttactttaaatcttatgcagaattttctcagtgagaattttctcacaatctcctagtcagactgttatgttcttacctaatcgccgatgttctcatatagtcttctgtacctctttaataacaattaatcttttgagttataattatttgtttccatgtgagtctctctacgagctattaaagtgctctgatttttttttttacttttgttaatctcagtacctatcctaatatctgccacatagcaggagctcaattaatattgtttaaataaaagaacaaaaagaacaaagaaagctataaattcatttgccttcccaagaaatgtagtttgacttttgagttcagaaatatattggtctttgttgagctaagcagaactaaacctgttactttgaaatatgcaaacaacatttgaaggaaataacaaggttcctcagggattgtgagaacaatgtgctatttctcttgaggataagtggcttctgtaagtaaaaaaaaaaaaaaaggttttgcattatgagcgtttttctacattaaggaagtcctgtgaccaaacagagacaacccctgttgttcttctttggagcttgcattagtatagcagacacaggttactgctgatttcaataggtagggcttttcagggggactgtttgttctggcactctagtgaggctttttataatcagaaaccttaatttccaagatgaatcattgctgacggactgaaaaacaccacttctcccaactctggtttccagaattttgccctaagaaaaatgagttccacttcattttaatggaaagtaaatagcataaaattacttattgtatttaaagatcggccctttatttgatttttttttttgattcagtgaaagaattaggacagagagacaatgcaaggcaggcatttttgatcaaggatggacagctatggcaaattttttcctttaggtgtatcctctgaaggaaataaaatagaatgaaagaacaaactcagaacagttgttggatgaccagtgagcacagcatggtgtgaggaatagagcactggactcgttctctcattgttacagtcattcaatatttcatgaaagagaattcaaatgtttggagggtgatagcttttgtttttgaagagcatggctatgatataaattaatatgattacaatgtaaagtgatgagtattaagagggataaatacttaggtttgtcgttggtgggaagggaggcattcacaaaacccaagccagaactctacataggagttagattgataaagaaagggaaagaaaatagttcagaaacagagaaaatgtgcaaagatgaagaaaaaaggcaatgcaactgtcatgaaagtatttaatagttgagaccaactagattacagagggcaaatgattaggaggggtgagaaacaaggctgcaaatgcatacatggagctggactttgtgttgtttttcaggatttggctgtactctgacggcaaagcttaaatgcaatacagcagggacaagatcttgggatctaaattcaggacacagttctatgaccctgggaatcattcctgaggtttgtgtcttcaagtaaaatataaagatggtaacacgttcctggtctgtctttcaggataatccaaatataagatgttagtattagccagacaggttttacagaaggtaaatcttaacaagaacaaaaggtttgttcattagcttcatttagaaaggtaccagctactttcttgaaggttattaataacttattaatatatggtctttaaatactaatttagtggtagccttataatctaaaagtatcttttttgactaatgccaatcatttagctgtaccaaaattttcctctttaatatttgaaaataatatactgaccatcattctcttgcatatttattgctgattcattatttcaacaatgcctagtaatacatgaatggcttctgttaatagcattgtgtataatctcgaagaatacctggaaatttcaggtgtagagatgtgacaattattttcttcctcattctctgattacatatcctatatgttgtctttaataaagataccttgtgttttttgaaagatcagttccaagtggtcgggggtgatctctcttgatggctcacaccattttccagaagatacaggaaaaattaaagtgcatttgatgtgctgtgtttctataatcataaaactttaaatatttcttagagatttcctagtctagactctcattttgcagacaagaaagccaaggattagaaaggaaaaataggcaaacgtgagcattgtccattcgctcctttaaacaggaaccacacttatgatcatggtcttttgagatctggggtaagttaaagaacatgtaaattttattaattgagatgcttttcattgaaagcatcagaaaataacagaaaaatttaaataaattggctaaaagattaagaaattataatttcccaaactgaaaaagtcccttagtagaacacctccagggtcagttaaattgatgcccaaatatcatggcctagaacccagcctctttgtgtctttctgctttgtttttctcaaactaacttctgccatggtgattacatggtttcttcagttccataattggcctgcagacatgacaactgacaatgtccagtagacagagtggtttctttctttgagtttctttttaagaaaaagtaccccacaactcttgttggttagaactaaatcttgcaccaattccttatctaattgcttgatgatacacagggttgagtggagaaaatagaaaagtaggtgacacaagtaaatattggatcctgttgaaaaccatcagggagattggatggtttgaaggtagaaaaccaaaaatacataccacagagatcagcaaaatagattttagaatctgacagacatataagttgcaccacactgtgaaaaataggcaatgccatgatccaagcacattttcaacaaacgtgtattaatttaaaatataacattgtccccgattgcttcctttatagcagaggcttctttgatcacgtttgagcaaaagggcaggtagaaagaagtctcgtctcctttcatattaaatgactcagtttccaatcaattttcattgtgttttctttccttcatttcttttttctttgttaacatgtcattggactttcttctatttggggagcatgaaacaaaataatggtgatatccctcatcaaataattagggttctcagggtctatcacaattatgtcttctctgctacatctagggatttgaagttcttataccttcaggagcgttgttctcaaaccttcattgtaacacctgaatgccctcatggttaacaggagtaacatgaggattgtggttagatatgcaacagttgacactgtgatgactgggatgagcaagcactcacctaaagacataccagagcaaaacccattccccctccaaagaaataccttgatctttgacttttgtttgctatattcacaatcaaaaactgtatactaaatggcttcattttataaaagagccttttaaattgtgtgttctgatattttgtctatccatatgttaattcaacaaatgttagttggatatacaatagatattaagttgcacacatgaggagaccaaatgggatagcacacagagcctgtctttaaaaagcttacagtccgacatcttttctcttctctccttgcttgggatgaaggagaaaagcaaggaaaagtaagtcattgatgaccatagcgtatgaaaagtgtcatgacaatggcaagaaaaatgtgctctgagacagcatagaaggggctcctcaccccaactcgcagatgagtttggatctttgaactgaaacttgatgggcaagcaatagcagcttggtgaagaatcgggagagaaaagaatactccaaatggtgctatatgtgaaagtactcagataagggagggtaccaccactaccatccttgctgtcatcatcattattatttcatcactaccattgttaagtgcccaaaccatgatgcttttctaggtacttttatgagatatctctagttcctacagtgacttagtagtaattattgttcttattttatagatgaaaacattaacttgcccaatgtcacccagactgtaagaggtggagatcatacatgagttcagataagcttactacaaaactgagctgactgctcatgctttctgcctcctatttgagtgtctcctaactctcaggtttccgccagctctaaggaactagtttttgttacccaaggtcccctgctattttaagcctctcaattgaagtttcctgttttctctcatgagaatgcttcctgttccttattatctggctggtagttactgctcctcattcgggctgaattcacagggaatttgtctcatcttggaagatttctcaaccctttttttttccagcctcaggaagacgacttgctttgtccttccctccccctgcaaacaacatcacatttatgtctatgtatctttgttatcctatcccttcaccctctttcctaccctgtctaccttccactatatattgaatccaccgctagactgcaagctcctggaagccaaggcagcctctcatttgtcattgtgacttcagtgtctagcattattcttgacacggaatgaaggctcaaaaagaacttgctaaataaatgagtgagtgaaggccatccaatgtggggaatgctatgttactgctccagaatattctttcatagtattaatgtttcattttatttgatatataatcacatggcttttattccagaagacgatatcactatgagaaaggaagctaaatactttgttggttttttcaagggattttctttctattgtgtgtgtgtgtgtgtgtgtgtgtgtgtgtttgggggtggtggcatatgtatttaagacaataagttagaagagataagaggtgggttttaaaaacgtaaatacaggccaggtccaatggctcacgcctgtaatcccagcacttagggaggccaaggtggacgggttacctgatgtcaggagttccagacccacctggccaacatagtgaaaccctgtctctactaaaaatacaaaaattagccaggcgtggtgtctcacgcctgtagtcccagctacatgggaggctgaggcaggagaatcgcctgaacctgggatgcggaggtggcagtgagcagagatcatgccactgcacaccagcctgggtgacagttcaagactctgtctcaaaaaaaaaaaaaaatgtaaatacagctgtagttggcttattgctaacttatttcattggagtttggctgaaaaggtttaaagtgatttcaagtttggagaagttacttttttccataataagaagaaaatatcttctaggcacctactctgtgccagaaagtctcatacccacaaattcatttgtttttttttttttttaccattttcatgctcagtaaagtagtaaaaatcaacagctaaccagctgaccttcatctagccctctgtattcagtatttcttctaatatttccagataggcattattctcattttaccaaaaaattttaagggcttaattttttgaatgcaaaagaggtagaactgggcctactactcagtcgtgctttgactccttatgtcatggaggcaagcccgttgcatcacaccacatggcaatactgcttatgaaaatatctaacttaagggtacttccttctaaaatatacaggcacttgactatcccatcattatatgctgacaggtgggtcttttcaaagtctcacgttttcatggtcatcaccccgctcaagtccttatcatgtattactaatggagactgtaaggggaggcccacctggaaacatcagaactgggaactcagacctcagtgaggcaggagaaacaatagagaatccagaaagcgcatctaatgggaatactaagcaggacataacaccataaactaatttcaaaggatagcttagggtctgggagagatggactattgaggagtaaggacaagtttgcacaaatctggatgaccagtgattttaagtccatttggactagtgacttcttaacattagaggcccaggcagaggcatctgtagcaatcttggtctagccaggatcagggtaagaatattaacaatagcaaccatgtcagaaatatatatgggattcaagtatttgcaaaacattttagattttttttgtgttgaatgtcaaccacagtcctataagacacacatacttattatcaacaggatatgataacatgaagaaggaaatgtatgttgttgaataaaaatagcagtatataatgaagtatatatacactgtatagttttataaattgcaacacattttggaaaggcaactgcttaagagagtggttgtgattacacgtacaaaatatttcaggcatttaaagtactgggctgaatttttcccagtaattaaaatagggcataagaggcagcatatgttctagagatcactagagtacaataagccaagggcagatatgaagccagcataaagtggggaaatataggaacaaatatcctattacagtgtgtgtggtctattcctggacactgtggttatagagtccaagttctgctgccaatgccacaataagaaagccatggacaaatgtagaaaacagttaataaaagtgatgctatctatgcctgatctaactccatctagtgagaagtttcgagaaagagtttgagttgagtttgtggaatagattaagagtaagatcaaggaggatagacttggatatataaataaaaactgagttcattcttaatgttcaggagagaacagatcctgcgtctgttgtatcttacgcagactctgttggtcaatacaaataaactatatccatttggtttcacttgctctaacttgggatttctcaacctcagtgctattgacatgttgggccagaccactctttgctgtgggtctgtcactggcatcgtaggatgtctggcagcatccctggcctctaccagtcagtagccccttccccagctgtgacaatgaaaggcctccagacattgctagtgtcctctcgggagcagaattaaccactggcttacatggtagctgttgttgcaggtgaggaaactccgggactaggagtaggtctgggtcattctggtctcatggcttctgtgaattgggagccactgtagcagtctatttttgggcctttctgaaactgaggatggttgagccacccaaagaacactcagaggatgcagcatttgtcaatcaggatttacagatggaggaatctgggcggagagttagtagtctgcccccaaatcacatggaagaactgatatttatacccctgggataacattctataccctgtctcttttctctataacaagtgatttttattttatgctttgcaaagccccaacacttaggtattgagtgagaggcaaagcaggaaggacgctcctgcatttctgctcctatccctgctcctgtcttggccaaagtagcacagctatcaccattccatgctgaggatggttagtgttccttttaaaatagtaacaaataatgttctctgaattattcctctatgcctgcttggaacagaagacagaccagtgttaacccagaaagcaacacaacaatattccttatgtgctgtcggaactctcttttcaagggtaaggcaggctgaggctgcagggtaaatctgaaaatcaacaaggtagaaagatacagagactgactcaaaaagaccatttcatcatccattcctggtctctttccagaacagtcatcttcttgcctccatatttcagtcttccaggctatcctgtgctattctgccagagtttctttcctggcaaagccttaacaaatagtaccccgttcttgagaatctgaattctcatcctgatagcatcttgcttggcaatcttcaaattctatattaatctaggaacttctcactctaccctttttcataaaataggaaatcatctcagggtgggagaatcacaacttgaccactcatctctcccctatttgcctgtcatgaaatctaagattctgcattttgagactgatttttttttaaataaagaggttgactgctctagttattttcttaaaagcagatgaacttgaaaattttgacatatgtatattttgtcagccaaaggcataccatctatttcaggaggcaatattatatccttgctaacaatgtgcgctttggaatcgaactgcctcaattcatattccagcttgccgcttttagcaatattatctgaggcaagttttcaaaatcatctgaaccttcttttctcatctgttagataggataataatgttctctatgttacagttatagcaattaaatgacatgatacatgcaaagtatttttaaaaataataaataatagccatcttcattattattactactttttttgaggagtcattgataaaagcaaatgcactattgaagagatcattaataaaagtcaatacaatgttgaaggtcatcttgtccagtttcacaatcatctctgagttattgggaaatgtgttataatgaatagatcaacaaaaatataactacagtaaggcaaaataatatgaaatgaattacaaagactaaatcactctgataagattgattgtcttctgactgatattttactatattcctaacatgggtctgagaaagaggagaataatataggcaaattgctacaatcatcaattaagtaaatttctaaaaatgttaaggaatgtataacacaaaacgagctaaagaattgtttgcagaatgagtgttgaagatattgggtttgtcatggttgccgttccctatatcatgctgttcttaccgttgctgtgaccttcttctcttgttcagcaggacattgacatgcagcatgtaacatgtactactagaagatgtaaccagtgatctggctcttatgccaggacagattttgttctagggtcctaaattggtactaccttcatcactgattatatcagtcagtggtccatgctattaatacaagcagcatgacaatcttaggggtaagaaacatgttacagtttagaaagatctgtacaaggtctacttacagagactggtgtcaaaaatttttatgagacttgggaaaatcatatatattttttcctttcctcttccctgggttttccttattccttaatacatgcaaagctgatggggtcagtttgggatctcgaagggaattatcccctctgtattacaagaggcctcatggtgagctatgctttgttcaaaaaggatgaaagcaatttaaattaaataacaatggataatcatctagtttattgtaaggtattgccacttgaatactacagttttactatggaatctttgtttcaatagttgttttttattttatatgtgacttactacaagaacttactctgttattttaatgtagctatgtttttaatatttcttgagtagtagtaaagagggttatgtcctgttatcatggtgacttacccctgccatccattcctggggaacttgcttggctgctatggtccgtgtggtgacaggttattccttggtagacatgaagtgcagagggtacagtgacattaaagaccttttcattacctgaaatcttcttacaaaccatctaccaaggtatgttagaccaagaaaaatgtcttctattttcttctacagattataaccagcaatacgctgagatgataatggggctggatatgaaaataaatagagtactttactttctgaaaatcattccatagcaaccgaatgcatttgggatgatatctatctatctatctatctatctatctatctatctatctatctatctatctattctaagagcatatgtttgtgttcaaatgtctgcttttctaaaaaagtatttttggaaactgacatataaaatgatcagtactagtaatgctcaatcctttcttgtgttttggtatagtactgactttttataatctatagacattttgcatataatttcagattagctgatatagctagggtttaattacaattacttcctagagaaaaagctcctttgtctgaacggtgataattctgagtatatgatttagatgtgcctattataactgggtgattgaaaaaaactactgagtaaattcacaatttaaacaggatgacacaaggtgtacatttaacttatttatgacacaaattttttcaagcctccattttatggaaaatatagaatactgtgtgttacttttatttattcattataggactattttcttttgggtccttctttacctactgtaagctttgtagcttagtttgcgttactttctgtatataaactaataaagaggcatatttttcaatagacatgagcctttcactaattcagaatgcctatttctttcattaggacaaattagagattatgtttttctctgaacaaaatgcatttttatgtcaattaaatgagagtttttgatgaaatgtttcctaacagagagtaagtaattgtgatataattgtttgtagatgaaaaataactgccacattcatggcaaatgtgagtttaatgcagatgattttcatgactatgatgtgttttatgcggctttttatacccactgttttggaagcattcatagtaccagttaaggcaaaaccagcttaatgtttgttttagtgcttggcaacaaatacagtctataaaatatgtagtagttaatattaaaagcacatgccagattgtaacataaagagtttattcaatctctttaaagtcatcaatttgaagcttcatctgaatgagttagcatttgagttccatatgattttcagcaggtgagatcttgtgaagttaggaattggctacccctgcgagcccccattggcacagcccccagtttcttaatgagcttgcctcattgctgagtgagcaaaacactcttaacaatgttccttttgagccatctttgttgcagggggaaataaagagaggcgccaagcctgcaaattctttcctgatcccattggttcaccaggagagaacaattttgttttccatggttgcggtctttcaaggttgcctttacttaggatttgattacctgtctccctcaaccaattagcctctcccacacactctcttgcctccaataatgatcaacctccttttctaagaccagcctcctctttatcatattgcattaaacacttgatgaaagaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtaattttctttattaaaaaatacacattaaagtcttagaatagtttgatatttaccgacaagttgcgaagattttacagagccgtatataccaccctattgctaatattttacactactatagtacatttgtcacaatgaggaataaacgttgtggcacattactattaactaaactccatactttatttaactttattacttttcccctaacctcctgttccaggatcccctctaacacatgacatttagtcattatttctccttagccttctctgaactgtgacaatttttcagactttcttttcgacaaccttggcagttttgagaagtactggtccctgattttgtaggatgtgactcaagtcgattttgtctgatgtttttctcataattagactggggttatgggctttggggaggaaaacttcagaagggatatactattcaattcatatcctaacaagggtctatgctatcaacgtgacttatcactgatgctgttaacctagctcacttggctaagacagtgtttcaggtgtctccactataaaacgctcttccccctgcttcgcacaccatactctctggcagcaatagttggcaccgcctacccttacgtggtggggaattattctctatctccttgagacagggcaagtatcaacataaattatttaaaattcttctattcggatatctgtctcttcctcttctcccaccccctgttgactttattcaatcacatatttattcaatcacttagctcctgcatacttttagcctacacctatcatttttgttttgtaagcatttccttactttctgataccatcataagctccaggatgatcttgtatattccctgccttggccctagaatcagcaatttccccgaggactctggtttctttcattggagaatggtttttgaaaccaagatcttggtgctgggtgtgctggtcactacaggggattcatcgcttctaggccctctcagtggacagagctaggaaatctatatgtgcatactaacccatgtatgtatacatatctataattatttcaatagccatccatctgtgtccatattaaatatttaagcatgagttcacaatgatgtttcctactctagtactgtaccacatggatcattctagtcttcctcctttgcttgtctgtaacctcccatttgaaaactgagaaaattggatctaactcttattggttcatttacttactttttccatccaggtatacatacatgaagagtggcttcaggactggtaagttatgttcctttgaaaaatagctttaccaactagaggacagtgctcatgtgcagttcctttgcccttttatcttctactttccaataatttccaaagttacttaggtcaacagtctttaacccaccctcttcagtgaagttatgttatatacttagcatacagttacatctttttgtcgaagtgtgcatttcatcccaggatctcttaatctactagttattttaaatttgcctatgttaaatttattctctgctctgtaaagttctatgaattttgacaaatacacagtgtcatatattcatcactatggtactgtgtggaatactctcgccaccctaaaagaatctcctgtgcttcacctagtcaactgtctccctccccaaaccccttcaaatctctgatcagttttctgtccatgtatttctgccttttccagaatgtcgtgtgaataagatcatagattatgttgccttttcagataggctttttttcatttagtaatatgcatttaagattcatccacattgtagcatggattaatagctcattctactttattgctaagtaatattatctgtggatgtgtccgtttgtttatccattcaccttctggagaactcggttgctttcagttttgggtgattataaataaaacttctagaaacattcaggtgcaggtttttgtgtggacataaattcaagtcaattgggtaaatacctaaaattgcaacttatgggggatatggtaagtctaaactgtctttcgaagtggctataccattttgcattctgaccagcagtgtgcttcaccagcagtatggatattgtctttttatttttttaagatttcagtcattctaataggcacgtaatggtatcttcttgttttaatttgcagttctctaatgacaaataatgctgagtatctctttatatacttatttgctacctgtatatcttctttggtggggagtctgttcagttattttgcccatttttaactgggttatttattttcttattgttgatttgtaagaggttttctaaagaaatatttcagatacatatcgtttattagatatggttgttgaaaatattttctcctagtctgtggcttatcttttcattttcttaacagtgtccttcacagaacaaaggtttttaattttttattgtatttctatcctctttttgtccatggttatatcctctactatacagagctgttccacttactgttagagcaaatcgtattaatttctgttgccctaaataattgtccattggccgagagctgtggctcatgcctgtagtcccagctacttgtgagtctgaggcgggagaatcgcttgaacccaggaggcagagattgacgtgagccgagatcgtgccactgcactccaccctggatgacagagtgagactccatctcaaaaaaataataaataataaataaataattatccattatattgtattgaaaagagctgctatatatggcatgataccactcattatgttagttttccccgttctccataaaatgaccactgtgtctgtcagagttgtcacacagaagtctctaaccatcttaacacctgagcatgcccaggactggaggggaactattgcgttctgtatagagtacaacaatcatgggcgttggactcagagacctcggttcagattttgctcttaacatttcctggttgtgtgaacgtagaaaagtaacttaagttttctgaactttggccttctcacctataaaatgaagataatatcgtccacgtgtcttaggtgctattagaaggacacatacgaagtgtttagcacagggcctgacggagtgtagcactcagtaaatgttagtgcttacttgcttttcccccttgtgctccacattttctttcagcctcctgatttttcccagtggaactctttaccttgcatccatcatttctattgcaatgcatttctatgccttttcgaggagcttttctattccatctacactgaaaatggctcatcctattgatacaatttccctgctcccagccaatggctgctgcagcacttcctgatatctagatcacaaagtccctgaacaggttagggtagcacatgttaaaaaaacaatattcctgcaagttcacctttctcttacttctcatttccaacctaagatcttttcaatgagcttactctgattgaatataaaaacaatttttaaataattcaacctaaaataatagaagtattttttgcttttattatttgtaattaagttataataattgtacacatttatggagcacagtgtgatattctgatacatgtatgcaatgtgtaatgatcaaatcagagtaattagcgtctccatcacttcaaacatttgccatttctttgagttgggaacattcaaaatctgtttttctaggcatttgaaaacatacaagaaatgttgttaattatagtcacctacagtggtatagaatgttaaaatgtattcctttcatctagctgtgcgttgtgttgttaaccaacctttggctgtgcttccccccacccctacctgcctctggaatcactattccactctctacttctgtgagataaacttggaaagaaataatactattaggatgataatttcccacaaattcatctataaatttattgcaattctaattaaaaatcccatatgatttattatggacctgtcatactaaaacttgtttgggagagaatatgctggagaattgccaagaaatgtatcagaacattctataaagccacaataactaaggcaatctgatattgacaatgtgtattttatcaatggaaaataataacataaacatatatgtatttatgtggtttgttcatatatatgtattgtgtatgcatagttgtgtgtatatatagtatttatatgcatatatttaagcataacaattcaaatcatcatggaaaggatggaccatagcaaagggtctttattacacaatagttgtgagcactggccctggcaccagactgcttgctttgaatctcgactctgtttccgggatttgaatctgtcagagctatgtgaccttaggcaggttgtttaatttcttggagcatggcctcagctttcttttgtgctgaataagaaaataatagtacctaactccaaaagtacttagaagggttaaatgaattaatgtaggtaaggagcatagaataggtgctggcactaagcaccagcgaatgtgaaccattcttattattatcatccataatatagaacgtaagcaattgtctgttcgctttgaaaagtaacccttggcagggcgcgatggctcatgcctgtaatcccagcactttgggaggctgaggtgggtgggtcgcttgaggtcaagagttcaagaccaacatggccaacatgatgaaactgcatctctactaaaaatatagaaaactattagctgggcatggtggcagatgcctatagtcccagctactccggaagcacaaaaattgcttgaacccggaaggcggaagtcacagtgagcaagatagagccactgcctcccagggcgagagaggaagactccatatccaaaaaaaaaaaaaaaggaaacctttagtgactagtttagagccctacactgacaggtgcctatccagttgctgatttcttgtgatgtggatttatttttacttcataaaataaagaggcaaccttacactttgttattaaaatagtaagtggtaaggaaccctttaagggatatggttttaacatattattcaaaataggaattgcaaactcaattgcttagagaggtcagcaagtaaatcaatgtactagactgggtagagcgtgtggtgaaatgaaggccttctagacgcttaagaagacaaccagttttcaacaccacccaattattgccaggcagaaacatgcgtgcacattttttaagatttttattttcatgcaatattttctggcttctaaatgttgacaacaaattcaaagtttgaagcattgtgtggatcaaacaaaatagatgtctagagatcagagttggttcatattgtttgttgcaatctgagacttagaacctcctttaggttacactacccagtctttctcccaacctgtgtaccccaattgtaccttgcacagtgctgcccaggtgataaggaatcaatgcttgttttttgttgaattaacttgattttaattctgaatctttctgattccaatcaatgctttgaattaataatactagctcctggccaggcacggcggctcacgcttgtaatcccagcactttaggaggtttaggtgggtggatagcttgagcccagaatttgagaccagccttggcaacacagagagaccccatctctacaaaacaaaacaaaacaaaacaccacaaaaaaacattagccaggcatggtggtgaagtgctgtagtcccagctacttgagacgctgaggtgggagaatcacatgagcccgggaaggttgaggtagcagtgagctgtgattgcagccactgcacttcagttggtgccacagagtgatacaccatcttagtaataataataatggtaatagtaataaaagtgatagctccctctgttagccatttattttaaatatcaggtgctggtagggtctttacacatatccctctgatcattacaatactccgtaaaggttgcttttctcactttatagatgggaaaactaagaggttcagttacctttctaaggtccaaggctagtagaattagtgatatgacattgtctaggtctgcctttttgagggagtgagatgtcaaaagtagtagcaagaggtccagatccctctagggtgtagtgtttcctggcatcagctaactgggaatactgatcacgtcttgtcctggaaacacatttcattggatgaccttgtcaggcttacaatgcaaaaaaaaaaaaaaaaaaaaaaaattacaggataaaagatgaaagatgtcttccacttacaaatggcaagcgatagctatccaaaggttcatttgtaaatcagttgtttgaaactcggaattcattttcctgcagaaacagttacaaatggtggttatgtttcccctgaggctcatccacaaaagaccatttagccttaatgtatctgaaatagtgtacatttgctgtgaaaatgtgtagaaaatagaactcttgtaattctagtaattaaataaaagaaaaagtaaaattgaatgagaactttaaactgcatcttgaatgctgcttcgaaagaaaagcagatttacccagaagaggatgcagaactttgaaaataattttgtggggattttaaagggggcttctgaatactttcacagcacttgagaagttaatgaaatcatatcattgaaatatcgcatttcatttcgtgatttctagatttttaacataatctttccatgattaatgctatttctagtgttctctttagaacaagaagaagaagggaaaaaagggtggaaaaggaaaagacaaatgaaaatgggcttcctaatgatgcagaagttgacagagatagcatgtgaaagaaaattaaagatcatgtttgtttttcgataggcatgcaagaagcaaaattagccatgaattatgaacagtggaaggaggaaaacatagattctgatttcacttgagagagacaaaacaatgctggtggcagagatcttttctctgagaaattccagaaactgttactgttttattccatcatcttagggcatcatacttcatggcaaatgtaggatgggtacaggattgagatcaagagtgcaaaagttgctcaaatggactaaatgttgagaatactaagtacttattaaacaagagaggatttgttctcaaacaaaagtaattatcattttttattgtctaggttttatcattcatcttgtttaaccttcagccaggagaatgaaagacagaagtttttaaaaaatatatatatattgtgggcggggtgtggtggctcatgcctgtaatcccagcattttgggaggtggaggcaggcagataaccatacaggagtttcagaccaggttggccaacatggcaaaaccccgtgtctactaaaaatacaaaaattagctgggagtggtggtgcatgcctgtaatcctagctagtcaggaggctgaggcaggagaatgccttgaacccaggaggccaaggttgcagtgagctgagattgcaccactgcactccagcctgggtgacagagtgagactccatctcaaaaaaaacaaaaataccaaatatatgtatattgaatggccaaatggttgaacaggaaattgaggaagaatgaacaacctcccagacacttccacagtgagtttgcaaggagcctaaaagctagctgcacagagcagaggcccttcctgccaaatgtaaccttctttagaaatagagaagagaaagacagttgggggacaggggttattatggatacaggacaaaaacaaaccagggtaaagaaaccaaaaaccaacaaggccaaaccaatggacaccttgaggtgatgtgggcagacacagagtgtttccctttgttgttctttggagagtaagataggcttccaccacggaccctcttgtcaataaatcttcctgggttaagtggttagttagactaaattgctcttccaccaatttgagctgacagcagcacagaaccgtcaaaaccattgctgtgttgtctccatagccaaagagtgttgttgatttatttctgttagaggaaaattttaacttgcctacctttattttttttaatcatttgaatttaagacactagttcccagtaggattcactatgacaattttcagtgatgagaaaaagcatcaagggtttctggtctctgaagaattgtgttctttttggccaataaaattaaaatgaaatagatttaaattgtattaattcctaatttaaagctgaagtttcaagtcaccttccattactattgtataggatttctacataaacctattgggacctgagacaggctaagccttactaaatttcctggctacagggatatttcttttggggattggagatgagaaggggtaatatcgacaatctcattttctccttaatttttccttgattgaactggtgtccatttgcttaacttattcactgtgtgttatagaaatttacaagttactttgcaagtgtagctatattcatgtatgtgctatcttttctttcttcaattaaattgtgagctcttttaagtaaggaattatattttatcttctcccacaatgaccaaagccagagtatcttacttaagacacttgaaagtggaatacaaaaagtattttcatgcagtccatactgccttgtttgctaattgctgtacacatgcagacatcatctcaccaactatgccctaagcacctcattggtggagtcttgttttgaggtagtggttgtaacagtttgggtcttttattagtgcattgtagggacagagtagcctctcaacaaatagttgtttgttaaatagtcaagtttggagggcagtagatgagacaaagtagaaaatgagagcttttgcattaaactatgacaactaaaatctatatttaaagtttacaacctaactgtatgttctttttagtacataccacatcattaaaacttgataaataatgtttcctcaatactgttacttaataagtaataaaaatatgatgctggcaataaaagctgttatattgttactgccttacctcctggttggtgagcaaatgctagaaagaaaaaatgggaaatagtttaaatttgagagttttggatcattttcttggcaaagtcaagagaccatttgcttcttttaagcagtctaaaaggtgtcaaaggattagaagcaaaggaaatatcagcattgctgtgctgttagacagattcctagagaatcaaatagggatggtaacaagattgagcaacccatctccttagaattttgcttccctttacaccgacaacctccctattttatttttaattacccatagaaataaacaggaatgctaaaatattttttgaagataaattctataatcatttcaagtttgattgttgataaatatgatatggatgaatataaagagtagattttcaatatgaaaaaagagtctcctaaaatgacgtgggttgtaaattggagatgaatttcttattagttttagtgccttttgtgtctcctattgtcaacttaaatggtctcacacaacacatctgttgctaggctcatgagatggagcagagttcaacaggtacatttcaaggccaggaaggctgataaactgaaggttcagtaggtaagagaagcactagaaacataatgatcagtgaaatttagtactatcaagaggctagaaatccggttagaaaacaaaccacaggattggtaggatctgaaagttgtcacagcttcaacagtcagtattgccaaagaaaataaaatggggcactttttaaaagcagtaaacttcgatttcactcaggaataactattgcaatgtgggagagacctcagcataacagctcagtccaacgaaaggcaggagactgtttaaatgctggggtgtacccaaagaaaggcattaagggagagattggtccatgtgattaggctatctgggtttgctaactagtgttcacctagaggagcaaacttctcatatctttttgacagaaattagtggtgcaagttggagcaaggcatccactgaagttaggtccttactgtcctacagggactgggaatgagaactattgccttgaatgtttgtatttcaaggagatggctctcatgtccttgaggagccacttctggatggtaaaagatttatttcaatgggggcagagaaaggatttataattgcaagctttctaaaataagtgctttaagagggattcaagggcctattggcctatcaccaggttttggctggaacaaacagtaaattctcctggcagcattgagctttctcagaaagtcattttaaggggggttagtgcgagaaagactgaaaaagaagtagtcccagaactgttctcaccttcgatgcaggctgcgtctcagcctaatatttgtcctgatattattatctcaggggactcacagtcaggaagagttggtaaagaggttgtcagactttaatctcccccaacttctagtaacttaccagaagatgccacaaagtttagtggtgatggagacccctctagctagaagaaacttttggtatttgtttttattctatttgtgatgtgttctagcattgtgaaatgaggcaaaaagaaatgctgaagctggttcacagaagtaagttggtgtaaaatcctatgtggtccaggtttatctcaacaatacaatctcctcatgccgttctaccttagccaatctcctcccatcaccatagcaaccacatcttataatatgtgattccaacttagagtgcctcatcactgccctttgtacatgcagattgggaaagatggaagagactgttcttgggaatagcacacagcaatctgggccaaatctgggtggtgtgtgccccactatttgccaagcttattatcattttttttctcctttggccttattcaactagaagtcctctgcatctactagaattcactacatatatagccccaatcttctttcttttatctctggcagtgaacaatagaaggcatttaagagcatgaaaaaataaataataagtgcagtatgaggtgtatggtagccattgctattaaaattactcattcacttttctatgatgaatgaaactctagtgataaataataatggtgcccctgaaaaaattaggtttgcaattaggacaatttctgccttgtagacaaactgcctaatattatgcttcaagacagttatttaccatagttataacccaatgtgtcctgctgaaatggcttgtttttcctacaatgttaaagatttaattttttgaagatcagtttgtttgaaacagcagctgtacttttaggaacataacctgaagaaatgtagatgtagatgtaggttaaagtgagttcatcacaggcaatcgaagatgtagtttaaagatgtagaattgttgatagtagtaaaaattgtgaacagtcccagatattgaaccttagaggactcatgaagttacataaggtaaacacgtgcaatagatacaatgtaacctttaaattgatggtaactgtataatatttttgaaatggaaagatttttatgatacatttttagtgaaagaagtagcttgcaagtaatgtaaacactgacatttagttattaaaagatacatatacatatttgtatatatttatacttacatacatacatacatacatacacacacttatatacatttggctaaacaaaagcttaaaagaatgatttgtaattttgtgaatgcttttgttatttttcgttgttgtttttctgagatagagtctctctctgtcgcccaggctggagtgcagtggcacaatctcggctcactgcaacctccgcctcccaggttcaagctattctcccgcctcagcctcccgagtagctgggattacaggcgtgcaccaccaggcccggctaatattttatatcttcagtagagatagtttgcaccatgttagacagtctggtctcaaactccttacctagtgatccacccgccttggcctcccaaagtgctgggactgtaggcatgagccattgcgcccagccgcttttgctatttgataattattttcctaataaaatcctatactaatggtgtaacaaccaaaataaaaaagaatgaggaacgtaaaattgcagtttgcttttcttattcattatgtcaacaaaaccttagccaaccacactggcccttcttctttttcctggccaagtcaaccctattcctatgaatgataactggagaaaatgtgcccagtgtggggaacaaggatatgttggtgtatacctaccatggtatctttctcaggggactgagtaaatacagggctctgtgcaacacaggaagaattcttaaggggcacctcaaattccaaaattcagatcctttaaagagagagggaaaatcagtactgccctctgacttggagtgagaatataccctgctgtgaagggaagaaggtcatcctaaggtgggaaaaactaaaggtaagtactgtacatatgtctgggacacaactttgaccttgggggagaaacacacccattactgagtagctttgtcctccacttataaggcattggatagatgttcaaaatggggagctgtacctatgaaacttttgaaagtcatggtaggggctatattccagaagggctgcaaaccctaagagatgggtcatctgcattctgagccttgacagtgaactgaaagagtggtcaccctctgaggaacctggaggccttgccatgcatggcgcaggggcttctgtgcatcagctatttgttcttgaagcaatctggtcagcttgaagaatctgaatatcatagagggagaaaggcttctatagagcattaaagcttgtgacctgaattcccaatgtatgcatttgttggtttatcctgaagaagagaacttaaataagatcatccgcacggcacagtttacacacaagcatgttatttttctgttttctctgttgcactcccagatttttaaaaaacacttaccatgatatccttcaggactcacctttcctggcacagaggtttttataataaatagtaatggaatgaatgagtgagggtgctatataatatttaccgatatcctacttttatatatcaggcctcatattatggtgcagggcagcacaatttatacccagttgttattgccatttatattcaaaagtatcaagctttgtcattttgcaaaaatgcttttcagtcttggaatttttatttatttagactggttttctctctctctctgcccctctctctctgtctctgttcttctcttttctcccaggtctaatgtatcagaatcacctgggatgattgttaaaaatgcagaattcagggatccagtgcccagtcataatctctagggctgggatctgaatattaacattttttaaagactgcagctcattctcatggacactaaattttgagaaccatttgtagttaatctatttaaagaatcacagttttatacatcgtccgtctgaaaatgcaaggtatcacctagaaacttttaagacaacttttcctctcctaggaactgtaaaataacaaagtagacaagtggagagtaagggtgatagaggtgggtggatcaataggaactctctttcctgtgagggtaacttgatagtgactaggcggtgcagttggagtgaattgattttgttcaaacaagttttcctgtttctcagagttcacagtgaacatttttttgcaggcttcttgcagtgtgctgtttcacaaaccatcagaggcatttagaagggccagggtttttcttctaaggcttaagaactttaaatctcttgggtggaagtagttttcagtgacttgtttgttcttgtgatataagacatagtaccactaaccccttgaatctatcattcctacttattgctttaaagccaggatagtatcaagttcttgatgtactttactaatcatggctttcattttctaatgtgtatttaatggatatctattcatttatcattcttaagtacagaacactaaagaaagcatactgtaatcagagatgttatcaggctcaattattttagattaactgggtattgttatgacaatactctgtgatatccctatcttcaagtacaaagtaggcaaggaaaaaaatgcacatcaaataaaaagtagttggcaaaactaccttttgatccattttctctctattagaaatatgaatggctctcaaatgttttacaaagattgtacattggacaccaatgaagctgttcaacactaaggcccaaaaaagaaacaaaaaaatatggtggctctttttgagaaacaatgaatttcatgtctttctagtaaaacacactataaaatagttcttcttgtgtttacatttatataatcattgaatcatatgccacagtcctggaaagttcaaacaggaaatagtgcgtatgtgtgagtggggagctactctgtgggactggtgatggcttggtggatattatttttcttttttaatcaaagtttagcaatcatacagaaatatgtaggcaattaccaaactcagtgaaatgtacacagatacccatgcctgtatagtcagcacccagctaaagaaacagaacatgaaaagcaccccagaaaactatccttatgctccctttcaggaactaattcttaaaaccattgtcttgacttctgacatcatagattagtttgcccttaagttctttataaaaattgattctttttttttttgagtcagagtttcactctgttgcccaggctggagtgcagtggcatgatttcggctcactgcaccctctgcctccccagcttcaagcaattctactgcttcagcttcccaagtagctgggattataggtgcgcaccaccacactggctaatttttgtatttttagtagaggcatggtttcaccatgttggacaggcaggtcttgaactcctgacctcaaatgatccaaggccaaggactcccaaagtgctgggattacaggtgtgagccactgcacccagccaaaaatggattcttatatgcactcttttgtgactggcttctttgcaacatgtttgtgagatccatacgtacttttgggtgtacttgtggtttgtttattcccattgcagtatattattgaattttatgaaatactacatatatatttatacacacacatatatacacatatatgtatatatgaaatactgcatatatatttatgcacacatatacacatacatacacatatacatacgtatatacacatttatgtgtgtgtatatatgtatatatatatatgtatattggaggccttggccttggatcatttgaggtcaggagttcaagacctgcctggccaacatggtgaaaccatgcctctactaaaaatacaaaaattagccagtgtggtggtgcgcacctgtaatcccagatactcgggaggctgaggcagtagagtatgtgtgtgtgtatatatatatatacatatatacacatacatatatgtacataaacatgtatgggtatatttatacatacatatgtatatatgtatatgcacatatacatacatatgtgtgtatatatgtatgtacataaatatatgcatgtataaatatatgtatatatgtacatatatgtgtatatatgtacatatgtgtatatatgtacatatatgtgtatatatgtacatatgtgtatatatgtacatatatgtgtgtatatgtatatatgtgtatatatgtacatatatgtgtatatatgtatgtatttctattgatgatagattattgagtaacatctaaatttaggcagctaaaaatactgctgctactcaattcatttcatacagctaatattaccctgaaaacaaaaccacacagacagtataaaaaagctacggataaatacttcttatgacctaaattttcaacaatatgttagcaaattgaataaaaatgtataagaagaattatacagtgtgatcaagtgagatttattccaggtatgaaaagctggcttaacattcaaaaatcaatgcaattcctcttatcaacagggtagggtaggaaaaaatagaagattatatcagtttacctagaaaaataatttaacagaatctgatatttatttactgcaaacatgcaccacaagttaagaatagagagaaatttccttaacttgacaaaaagcatctacaaaaaacctaaaattaacatcttagatgatgaaagactcattattttcctcctaaggtttgtaataaagcaagaatgtattctcaccattcttattggatgcagcattggaagttctagccattgctacaaggaaaaaataaataaggaaggaaggaaggaatgaaggatgaaaggagaaggcatacaaattgtaaagaaaattatctccatttacaaatttcataattacatagaaaatctggagagatctacaaaaaaacttacataacaagtggatgagttcaaaaaatcataggatgcaagatcagcatgcaaaattttattttttataccaactgtgaacatacaacaatcaaaatttgaaataccatgcaagctaaaatttttccaaagaaattgcaatctatttgtgtatacttaataaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattcttaatttcttaataaattaagcatgtacagaatctgtatgctgaaaatgacaaaatgctgatgaaagaaatcaaataaaatgtaaatgatagaaatatattccatgttcatggattgagaagctcaaaatagggaagatgtcaattattcccaagtttctgttttgttttgtttttacacatagacaagcttattctcaaatttatatagaaaggcataaatcttgaattagctaaaaccatcttgaaaaagaaaaatgaaatatgaggaatcattctacctgttttaaggcttactgtataactacaaaaataaaattattgtggtattgatagagagatacatagatcaatgaaaaaatgaaaaaaaaacagaactattcaaatatgccaaactgattgttgataaaggtgcaaatgtagttcaatgtagaaaagatagccttttcaacaaatggttttgcagagatatagaccaatggatcagaacagagccctcagaaataatgccgcatatctacaactatctgatctttgacacacctgacaaaaacaagcaatggggaaaggattccctatttaataaatggtgctgggaaaactggctagccatatatagaaagctgaaactgaaccccttccttacaccttatacaaaagttaattcaagatggttaaagacttaaatgttagacccaaaaccatcaaaaccctagaagaaaacctaggcaataccattcaggacataggcatgggcaaggacttcatgtctaaaacaccaaaagcaatggcaacaaaagccaaaattgacaaatgggatctaattaaactaaagagcttatgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaactccatcaaaaagtgggcgaaggatatgaacagacatttctcaagacatttatgcagccaaaacacaaatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactgtaaactagttcaacccttgtggaagtcagtgtggtgattcctcagggatctagaactagaaataccatttgacccagccatcccgttactgggtatatacccaaaggattataaatcatgctactataaagacacatgcacacgtatgtttattgtggtagtattcacaatagcaaagacttggaaccgacccaaatgtccaacaatgatagactggattaagaaaatgtgacacacatacaccatggaatactatgcagccataaaaaaaggatgagttcatgtcctttgtaggaacatggatgaagctggaaaccatcattctcagcaaactatcgcaaggacaaaaaaccaaacaccacatgttctcactcataggtgggaattgagcaaagagaacacatggacacaggaaggggaacatcacacaccggggactgttgtggggtggggggaggggggagggatagcattgggagatatacctaatgttaaatgacgagttaatgggtgcagcacaccaacatggcacatgtatacatacgtaacaaaccttcacgttgtgcacatgtaccctagaacttaaagtataataataataataaaaagtacaccccccaaaaaacaaaaaaaacaaaaagttttgcagcaagtggacatctatagacaaaaaaggagcctctacttaaacttcttactgtttataaaaatcaacttaaaatgaataatgaacttacatataaaacatataaagcagttaggggaaaaaaaaacaggagaaaatcttcaagatttaccatgagacaaatggtttttagatttgacaccgaaagcatgatccaaaaaaggaacaaatgagaaatgtactacatcaaactaaaaaaaaagtagtagaagtatttgcaaactacgtattcaatgaaggactagtgtctagtatatacatagagctctctaacctcaaaggaaaaagaaaacttcaaatgaacagaagacataaagaaatatttcacccaggactatatacagataacaaataaataaatgaaaaaatctttaacatcattagctattagttaaatgcaaattaaaaccacaataaaatatcatgatacccctatcacaaagcctaaaataaaaatagagacaacaccaaatgctaacaagaatgttgagaaatggaatcattcatagattgataatcaaaatgttaagaggtacagccaccatataactagcaattgtactctttggcatttatcccagagaaatcaaaactcatgttcacacaaaaacctgtacacaatagctttacttaaataattgtggtataaacttatcatggaatactattcaacaatggaaagagatggacaagcaacaacttagatgagtcttcagagaattattctgagtgaaataagccaacccaaaaggttactgtattagtccgttttcacactgctataaagatactacctgagactgggtaatttatttaaaagaaggaggtccaattgattctcagttctgtatagctgagagacccctggaaacttataatcaggcagaaggcaaaggggaagcaagcatgttcttcacaaggagagagagagagagagaagaaggagaagagaggagaagggagaaggaggagaaggaagagaaagagaagaaggagaagagaggaggagaggagagagagagagaggagagaaagaaagagagagagagagaaagagaaagacaacctaggggaaactgccacttttaaaccaccagatctcatgagaactctagcatgagaacagcatggcatgatccagtcacctcccaccaggtcccttcctcaatatgtggagattacaatttgggatgatatttgggtgagaacacagaaccaaaccatattagttacagactgtataattccattaatataacatttaaaaaatgccaatgttttagaaatggagaacacattagagcttgctaggggttagctgtgggggacagagaaagtgaatgtggtgatagaagccttttattatatggaattgattgaatctatttttgcctatttattaaaacatcataaagatagaatgttttgagctatatgccttgtaaattccatcttaagtggaaataacaattatgagaatcaaacgtatcagttatctattgctaagtaaccaccttaaatcttggttgcttaaaacagacatcgtttattactttccgtaagcaaaagtcagtcgggtggttctgatctggaccaaagtcagcagattttggctgggttcatttacatctgcagtcatatttaaacagaggtagactgaagataaaagtatgtcaagaaaagaacacaaaacagccaacagtaattttagtcagattttcttttatggaaaagtcttgtttattgctatttcttttcttgttgacaagcttcagatagagactcttcagctttattttgtcagagattgcttattagccaatgcgtatcttgtactttatatgattactgataaatgtcttgttgagttgtatttgaagtcctggaaaaataaacctcttgctcagtcacctggatccacaataacttcagtcaccaagttcactccttgagtaagcaaagtctccacaacatctgcatatttgtggccacacaagattgattattttaatttagtctgacaacttagcaagtgtaaacaagttaatgaaacaaattattgtgcctatgggtcagttaaacaatgtttggactcgtttttccattttctcaagtagctgtttagtaaacgtgacccaggagttgaataaatgatgtaaatgatatcttaacagaattggttgaatattttgttgtcaccagagccagtcaaaaccccaaaataattaactggaaattagtaagaccctctgacagggccagtatcagtttacttttttttttctcaatattcttcagaatactgaacttggcaacggggtggaagatcaaggagaggtgagtttgtttctgtgaaaaagaagaaaacacagtgtacatctgttccactaggttttcttcctctaccatgtagacagtttgaaaatgttcaatggccatagcattcagcttccctgttaaaacaagtaccataaagtattcatgaataacaaaataatcgtattcttttttttttaatgtaagagaacaagatgctaaccaggaaccacatcgatcctgaaagcgctttttggacaaatcacaagcctgtgattaactacaaagagcttatagaaagccagaactttcaaaataaaaataaaaatgttgacaaagattatcaaagaatactgtgcaatatatatatttttgtcattaaaaaaggagtgctcacgctagctgatccttgaatttcattagaagccaggatggctgcctgtggaatgcagtcctttttctggggcttacaaactggaggacctcgctcaggccttgttaaccagcacatgctgtatattaaataagattcacatttttaaaaatcttgatttctacttcttctgaaaaatctgaatatctgcttctgtgcagtcaacaggcctgcatttgtgtatcgtagaatcatctggagctgagcggtggcactgtcattttgtcatactccccatcagtccctttgaacactggggacaactttactcatttacatgagcttccaagtcactgtagacttttgagtccgagccctttgtgtcactctgagactggaccttatttcttttgaccaaggcagataccactgagggtaatagtgtttgtggaactcaagggagtgactccaactttggagccgctgaactccaataatggcatgcagaggctgtgagcctgttcaatacctaagccaggttcatgtcctggatcgaacttgaggtatctccgacaactctgaatctcctgggatccactctagacttgcgagacttgcaattagatttaagagcacgttgcctttagaatcatggagctcaaagaatcagaatgtaagtggaaactgaggttgagagagcttgaggactttcctgaccttcttgacattaccgagttctgaatggggaattcatttaattaggtgagaagttttgtacctcattaatcagttcttactattattttaatttttgaggtcttaataacagcaagtaaaaacatactttgttttatctgccacgagttagcccacagtaacccagtactgtgctacccaatgtgttaactatgttgttttgtggttttttaatgtaatgttttgtattcattcactgtcctatgattgtatgtatgtcagggccaaggtctagcagcagtggcttcatctaggagtttgctagaaatacagcctctctcatcccacaccagaactcttcaacaggaatctcgaacaatatccctgggtgattcatatagtgttcattagactttgaaagacattgacatatatacaatcatataatacttaaatgaatatatagcataatataaaaggactacaaaataacatagttaacaattcaaatgtcttcaggtatagaggtttttgcagctacttccatgcttcagcacagaatggtatggtatttttctgtttatttcattgggctgcttctaagattttttttttttttgaagaacgggtttcaaaggttaaaaaatacaaaacaagttaaaaacaacctgttattttactagcacaaactgaggagagaaactagaggaataaggttgaattagctagacaaagctctgtggagtgggttggtaaatttgaatggcctttgttgatattgagaggcacaagctggccatgaggtctaattggaattataacttgaatcctaaagagcttgcattgttgtcgttgtcaaaagacaaaattacaacaaacttagttatagttctttcttactcacagttcatgaatcaggacagctgccgttctacaaaatagaatgagagctcccactgggcactggcagagcggtgggttttgtaaggtggggacaaagaaatgaagcaacagtaaaaagctgactggttaatgttaagttaatttttaaatgaaggttaaatcagagaggatccacttattacactgactcagggagcctgaaatctcctattttcaggaaaaactgttttttttttttttgcggggaggggatctatctgcttccttaatgtttcagtttgattatgtgtcattcagcatgagtcactccattttggtttgcactagtgttgtgcactagtgttgcactagtgttgtggcctaatgtaggaactcagtccaaagcaatagcctctcatgatctttgattaacaggtctttattgtgtctcttctggcgtgtctgggctcctctcttcttcagctatctcctcccctatctcctcctccttttcttttcccttgccttattcttctgtgttgtcctgccttgcattactaaactctcaatcctacgtgcctgaccaaagagctgatcatgttaacccacaattatctgaacttccaccaagggaaagcatatataccctaggattagagatgggaaacgtgcctgagatgaaaatatttaagtaaggaagaagggttggggctagggttctcctactttgttccgcactacccacacacatgtagttaaagttaaaaaggttgcttgtactctctgatacaatttgggagaacattgaacttactggaagattcgttagtgccacattcagtcaccaggttaggcatagaaggaacagggccttaatattaatacattgattatttcctatgttaagaaattctggaaattcaacgctgtagtactgccatcctgtgtagatcagactgactaggccgggatttccaaaagtatacttttatgagtgcgtgtgatgttgatacagcatggtattgtacactgcatttcaatttcttttcatatcatttggggacatccatatgggtcttgttgaaaaaaaaattacatttccttgtggccaaattacaagaaaaataaaatacaaagttttaggtaagatattaaatagatattaaatattgagtttatataaaacatccaaataattttttaataatattttaataagcttcattttatgagaatactgttttgtataaggttttcttgcttgaacagctacaagtaatttttgaagaaggcaatttaatggtgatcccttttaattctttattatcacaaatagcattggatataaggagtgtgtatattactgttttcttcatttgactgcttctttcttgctagcaaccagaatttagtttctataaattataggtcaaaggacttgtagttctgtaactctcatgattttgatttgttttttttcttttcagtgaaactataatgttgaaaatatttgtgataatgcatgcatatggatttatcagttttttatattgttttccaaaaataatgatgatgcttttcttcaattatagtcagatattgttcttctagtgttaaaaattttctttcagaattcaaataaaatgctggtttaacataaccaatcaaccatttcaatctccctttttaaagttgagtttttctgaatccataaatttggtcattaaatattaacataattttacatgttgcaatttacattttgcataattcacattcttgcaaatttcagctaagttcattccagtgctaaaaaaatgagaagtcgatttttgaaagcaaagttgaaaagtactttggatctagtgatagtgttgtgctttcataactagcctcttgaactccagctaatactgttgtaaataccttatagaaaatttttgttccatatcttgcccttgcacacatttaaagttcaaatatttcctgtacggatagttgcttttgacaaggtaccagtgtagtatgtgacaatttgtttaatacctttgcatgcaaataaataataagtttggaagaaaaaggaagtatcagggcccacaaatagacatttgagagaatcctcatgttgctctttagtcctgtcagcttctgtggtggattcttcatttgtgttataaatctggtgacttcaattttaatacactcttcctaattgtggtgggaaaataaatgtcaagtaaaaattaaatctgtttaagcataaagttctcaacagaaatgacaatctttacaaatttagcaaattaattttctgattattagactattaagtttcagttaattgaacaattaaaaatgtttaacctttataaaatgtgattttaaattttaaaggcctacagtgtctttaataaatcaatttaaatgaattaggctcaattatttttatgagaaataaaaatttgctgaaacaaacaataatcagtataaaattccctcaaacccactctggctaattttaaatatcagaagctgataaaaacataagtaaatccagaggttttagtctagaaaattaacaacacccgttatcttctaaatatcaatatctaaaaagaaaaatgagaaacagcaacagcaatcggaagtgatttctagatgagtaatcacaaagataagcacgttaaagggaaagaacaggaaataacttacatgcactaacaaacagaaaacgtttattgaaaagtaaatcacagagcagtggaggtgattgaacaggtagatgctgtgttttattccaataaagtcttcatctgctgaagtaataattgtcaaattcagaaagttacatacaaatagtgttcgaatgtaatttcaactatttaaattttggaataattgcaaaaatggctttaaattttatcacctcacacatttgacagctatcaatatgtcagggcccacctgtgcctcatttgttgcccctggctgagttactctggcctagtggggaagcaacgggacaggggtgtgggacttcctgggtttgaagctaggctccatggcttatttgttaggtgatctcaagtaagttactttgtgcctcagtttctttatctgtaacgtgatgataatagcctactacacttttggctggcatgaggattaagtgaggacacatatttcatccctgaacaatgtctaatgtagagtatgttctcaactagggtggctcattttgatccctactaccactagtaatagtaatccatgaaaatagggcctgtggtcaaatgataaatgttgaattagggcaaaagtaagcagctgttctaattacagaattatagtacttaatatccttctaatatgcattgtgaatctctgagcggtggcagagccatagtgtatagtgttttctaaatttacatagccgtacgataattattttggcccaaggatctcatgtggacactgctgtgcagaagacattttggaaaacaccagcctcgtggcatccccagactaaatgagcctctgcaacatccttttaataagaaggtcctttccaaagtccagtcccagccctggcccagatcctcctatttggaagcataggcttatgctctgtgtcaaggctgatttatcagatggtaaagcttgatagaactataataaacactcttcttgatcatgctaagtaattttaaatcatctaacactttaaatcagcctcagatttttcttgcttctttgaagacctctgccagagagaacatttggagcactggctccctcagacaccctttgggttgcatgtgaatatttccatcgtatttgaatctgttttcaaaataaagcctgattagaaactactttaaatgtctgaccagagtccaaacaccctcagaagtctttgtgaaatgtcatccatgcccggatcccttatgtatttataatattcctgctgtatctttttcccctgcactgttatgttttagatattcatccccttcttctctccaggaaggagtgtgcaactaatattaaacacagagacagccttcctgagcagctgccaacagatgcacagcccttgggccaagttcagctgtcaaacagccctggcccatgaaacaaagggcagaagcttcccaaccacatgcggatgagcagaaacagctgcatttgctgtagccaggggcccagcatccaattcctgtgattcttaataaaaaaataccaagcacatggaaagggaaaattaaatactattctgacaaataccataattgctaacatcatctcccaggaaggcagcatggcagataacccctattcatgagcctttgtcccattgcgacaatcagtgctcaacacactgcattttagctttttactcagtcaatggcctggcaagagaattgtctttttttccctggagcttgaaaatggagtatatgaatttgggagcatatgaagttggtaggactagctcctggaggtaaaagtacctcagattatacataacaagtgattatatttcaatcagcaacatctaccgtaaaatacataagcctaggggcacttaagaaagcatataaacctgggtttgaatatggtggtagcactcagctgtgtccttcagcaagtttgttaacccatcagagagttagttctctcaactgtgaactgggctgatgtgaagattgaaagaaataatacctgtaaaacccttaacaaatgtctgaatacagtgaaagctcaataggtgttatttttattatatatctatttgctggtccaataatttttataagaccagtatgacttctccaccagagactgaccaggaaagaatgccttctgaatgacctctcttgcagcaatagcacggtaggacctatgttttcctcgaagggttaatttctcattctctggctatgtctagcactaacagttccattagagaatctcttgccctcatgatcttgttctgcatctggtaagctccccacatttgttcccctcttcacatgtcttttgcaaaatgagctttctattggtggttggctctgccccacactttcttgcctttataactctgtgtaggcattttccattctacttcctacttccatcagctatagaaggcccaacacccatttcagctctactccactctagcacagtaattgtagcaggggttttcctaatttccttgagggaagaaggagagagaaagcagaggcaggtaaagggcccttgagagggctccctcacgagctccacacctgtaatcaatgccagaagactcaatgcacattcagaggccaccggtgtagactggaggcagccgagaaagactttgtggaggaggcaagatttgaagaattgatagaacttggcttatggagaagcaaagggggagaagagggagaaggtgaggagaaacaattcctgagtattagaaaaaggtctgaatttggagctttaagatctaggtttgtgatcttgggcaaggtacctaaaaactctgaattttagttaatccatgatgtatatatgggggcggggggtaatgtgaactcagaaaacttgtgtgagaaggtgcttaaaaattagttgaattgaattttatagaagagacactagtagacgtatttagttgtaagatttttattgtgatattaatgctgccacgctaatagggtttaaagatgtagttgaatcctgttataaaacaagcatcatgtcagatccataattagcattaaagtattcattgagtgcccattatgccctggcaagctcatacctcaaaattgtgttcttttacttacatatgatttatactagggtgttttatgactttcaaagaaatttgccttatcaaggaaaccaattatacctgatggactcctgcatactcatgtttttcaatttaaaattatctttgattctactgatgatcagaaaatttgtgaaaattttagaaagtccaaacttttaaagtttggaaaatacaatgaagaaataaaaaatcagaatgaactgtttcctactcaaattttcattcataacataatctttggaatattattaatggatttatattattccaaagtgtgggtatcttgtaatttatgaatatctcatctgttccaagcttttgctattgtaattaaacttgcaatggatatcctttgtataaaaatcagtctataattacttcctttctttgcatctccatgaagggaggagaatgtttcttcctcatttataggctcaacagcccaacttgaccctccagtttgtcacacacatcttttctgcaggataagaaatatcagtttccttgcacactagcagaagtggttcatttccactggaaacttaccagaggcattctccaccagatactgcatttccttaggaaaagttttacctattttgctgagaagattttactcactgaagcataaaaatacatgctctcaagatgaatacatgtcaggtaagttctagaaggattaattttcagttatttaattctggaatttaattagatcaccttggaaggcaaatttaaagaacattcttagacaaggtattcataattcgaaaaggattttcctaagaactgataagcatggtggtgtctttccctttagtgctttttcctgggggcatttagaattcatggaaaacagttgtcaaacctcaaaaaatggactaatgaatgaatataagctcaaaaaatggactaatgaatgaatataagcttttactcaagaattaggaaggattaacatccttttgctcattctgtgaccagatgtcttgtatagggttatatatatttcatttctgtttctctggttaagggcatcagttgaaagtgtttgttacagctgaattgacttgtgcattcatactctaaatattattttaaaatatctaattaatatattattcaccgagcgactcttttttagtagaagctatcacatcagaaactctttattctgacaaagtgacatattgtataattttattcccaaagctaatttttttattttaagacatttcatgagatgttaaaagcccctagtgaagactgttaaatgagccattaaggttaggttatcaatgatcaactaaccaaactatcttaattttcttttgattgaataatagtaacagcaacggtaggaacacacatatgtgcaactaaaaaataaataaaagtaaggacaaactaaaaaataagaattatgcaatgggcattatttaactttgaaaatgtcctataagatttcaagggaaaaagtaaataaaatgtatatgcacgtgcttacattttctggaaacttctgggagcaactattttgcatttcaatatatttttatttaatataaaactaaaaagttgtcttaaatagaagttaaaagcagtttgctttccatacgcaattcattatatcaaattggatagtgttcttggctcagtcagcagcagcagcagcaacattgagtgcccttgggtgtggctctgtattagggtacagctagtaaaattgtcatttgagatagagaaatagtgtcatctcttaagaaatatgctattttcatttaacaaatgtttgttgggcatctataagctgtccagatgccatgctaagcactggggacacaggtatgagcagcatatacatgatcctggctttccagcccttaggttctagtggacactaagacaagcacacaggtactatgagaaatagtagaaagctcctgtgctccaggaaattagaactgaaaacagtttgtagtgccaagtagacaggtggaaaatatgtgtttaataaggaattagcataaaatatagagatacactcagtgtgcattcctatacattcaaatacaggaatgcacagtggcagcaaagtgtggtggtgagcagatgaactctgggcacaaattgcccagtttcaatcccggctccactattcctataaggtaagtggagcaagttaccttttgctctggaagccaggacagggatggtgggcagagagagaaagggccagagagcgggaagtgaggactgctggagtataattaaagcaaagcaggtatagtggttccaagaagaaaaatttctttcaagaagaaaaatccagaagaatggcttgtgcagcaggtggcgtcacacagcatgtaagagagggacttactttaatgctggtaggaaccggtaagaggacatagaaacccagaaagataagggtacttgctcgaatctctcaaccaacaagttcagaaatctcatgtaggacgtggtgaggtttatcaaaatggggcatgggatgcaatgaagtagcagagacactcaataatttcgacttggaagactggaggattcattaccataaaaaaactgaacatgggaaatgaattataataaaaatataatgactgggtgtttagtttgaataaagaatagaacatcactgtgtaataatcgctgagaggtttacaggtcaaatggaagattgttctgcaagagaaaagaaaggtaaacactgcaagcaactacaggccatgaacgatggtaaaatcgatgtgggagacagagcactgaactgggagtcaggatacctggcctctactgaatttttagcaaataacagacttttcctgcaccctagtttcctcatctgtaggcattacataaacaaatattttcatttatgtttctgtgagctcaagaacattgcctggtatttcatattattaagtgcttaattttctattttagtgaaagtatgctgcaagaatttagagacagtggcaggtaaataaagacagcaataaggcaaaaaaaaaaaaaaaaaaaacccagcaaattgtcaataaaaacagtagttaaaagctgatttctggaggcagactgcctgagttcagatcctggctctctgcagtgtgatcttgggcaagttactcaacttcttctgcctcattttcctcatttataaaatgggaataataatattatcttcctcatagtatttgtggaaagattaaacaagttaatatctataaagctgcttagagcagagccttttacatagggagtgtgcaaaattgctattaagcttcactgaggagatgaaactcacttgagctggatattaaagagagaaaggtttggagagatatttcaggccagggaagcagcatgtgaaaaggaagaagcaagcatgagtttgacagttgtgcatggaagataatcgtgtcactttctaggggagaaagaaaccaggatgaataatggagagcatttatttctagtacagaggttcctgctacaaggattaggaaatccggtcatacctacattgtgcctatctctgtaaagagacaatgggacaatactggaggttttcaaaagggagtgacataccatggctttggagtagctgggtctgataggcacattctgattgagtatacattactgaggtcatttggccagggttttctgcaagagtaaggcaaaagataatgaatatttttagaaaatagtagtttcaacatactccaaaaggtttggtattagtgatagaatgggccagggtttaagccatgaaagaaaagccttctctttgggccttttcatctaaattacaggtggtattggggtccctggagagagttcattttgtagtgaaatgctatgttttgtgtggagaagttttctatcagcgcttttgtgaaatttggaggtctttaaaaaaatctgtctaagtaaatggtaactaggtaatttgggagaggaacaagtatagtaatctcactgaaaaagttacagttttatttgctaaggattatagaaatagtaaaaaaaatgtgaacgttttcatgggctattacatgtatgtctttgttataaaattttattgcttaaaagatgtcctcatccacagccatgtcacctgagcctgtgcagtgctagtatttgagcagatgctgagttttcattttgcttcaaagtccattaattcagaactctttaagagtgcctttaaaagttcaaccacatttaactcatcttatctacctttgcatttcccatcccagttgactaaagttttttatactataagtgatcacatgttaagtaagatctgtaaatactgctttagctctgggaaattgtttgaaagcactttaaaacatggagtctttctccattattgtatttctttctgtatttattgcctatcatcttaaaaaaatctgaaaactgaagctatgacaaaataatgaatttgaacatatcacaagttgataactaagataaagaatgttcttttataagacattgcaaagggaggttttatcctctgtaagtatgccaaaagaatctacttggtctcaggtgttgccattggatgtcaacagtgataggccatttaaagataaggccataaactgatatctagagaacttttgattaattagcagctggaggataaatgcaaagaagcttcttgagtgtctagatagactaaagtttgctggatgaggtagatagagacatccttctggtggtttctctattgtctgagaagcaaatgctaactgaatatatagatagacattacacacacacagaaatttttaccttctctcttttcacaaccttgctattgccctttggcaatttcttcttcctttatattggacaagactgatcctgatatcatttgtattagtcagtgtccagtcaggaaaatataaaccatatcagatattttaacagaggaaagttattagaggaaattggccaaacaagtactgaaggactagatttgagattttacagagctagttatgaaggaagcagctaccacttctaaagtggtggtggggtgggagtggggcagggagagaagatgtttggggttcttaggatgaagaaacctggaaaaggtgcctgtgaaactgaagtccagacctttggatggaggggctctgtttagctggtagcactatatcagaagctcagagaagggacactacagaattggggcctacacctctaatgagagtgttgcttatactattttggggatgctgcaacaaaataccttagactgggtatcttgtaaataaggaaattatttcttacagttctgaaggctgagaagtccaagatacaggtgtcagcagattcagtgtctggtgaagatctgactcctggtttgtagatgactgttttcttgtgtcctcataaggtagaagtgcaagaagtctctctcgggcctcttttatgagggcactaatcccattcataagggctccatcctcatgatctaatcacctcccaaaggccccacctcctgatatcttcaccttggagggttttgaacatatgaaacttaaactctggattttggagagacacaaatatttagaccatagcagggtactttgccaccacttcaactatctatgaggggtcacaatgaggctggtttgggaacactcaatgagacgcaggaaatggaaccaactgctattgccaggatgaaaggccattgttgaggtgacacctgcaggaatgtgagcaaaactggaagaaacaagtcctttgtttctcctccagcctctaataggttaattacagcacaagaattttaactaagcgttactgttatcaaagcatgctgatagaaggaccttggagaccctctcaccatacacagacatatatatatataatatgtatatatgtgtgtatatatacatatatatgcatacacatacatatatacatacacatatacatatacatgtacatgtacatgtgtacatgtacgtatacatgcacacgtgtatacatgtaggtatacacgtgtatacatgtaggtgtacacgtgtatacatgtgtacgtgtatacatgtgtatgcatgtgtacatatacgtgtgtatgcatgtacgtgcgtatacatgtgtatgcatgtacgtgtgtatacatgtacatgtatacgtgtatacatgtacatgtatacgtgtatacatgtacatgtatacgtgtatacatgtacatatacatacacatgtacatatacatacacatgtacatatacatatacatacacatacatatacatatacacatacatatgcatctatatatatatgcatatatatagatgcatctattttatagatgcatctaagaatagggtcagtggtgaaccataaactagaatgatgagtatgattcaggaaaaaaaaccaaaaactaacatcactcttgttcccattatgggtctataattttattaagttattcagagatagcatctcagttaataattctcatttaataatcccaacagccttgttagagaagtgggataatttccatatcgaaaatgaaaacaatcagactcagaggatttaagtaatttcagtcagtcagtaagtagcggataggattctggccaaggtctgtttaacaacaaaggacatgtttgaactctcatccccttcaatggaaaataaggcaaagccaagaagccaaaagtacaggcacccaacaaagtgggaggcacagaacaagggggagggcaggtatgaacatccagagcgactttgattctagggagatgctcactcgtctacggaaggtgtattgtattcagtttctgtacttccggtcttcactctagccttgccttctggattgttctaccaagtactttggcttttctcatagtctttcaaaaattgttaatattattttgattgaccagtcataattgtacacatttaaggggtacaatatgatactgtgatatatgtatacaatatgaaattattaaatcaagctaattaacatatccatcactccaactacctatcattttttatggtaggacatttgaaatttactctcattttgaaatgtgcaacacattgctgactatagtcaccctaatgggcaatagatctcaaaacttattcttctgcctgtcctatttgaaacttggtaccctttgaacaacagctccctacttcctccctccccctcccctgccaggctttggtaaccatcattctattctctacttctgtaagtttaatgttttaagattccacatataactgagatctcaaacaaactcaaatcagtatgtcaaaggaatatcttctgtcttagtctgttttctgctgctacaacagaataccacaaactacgtaatttatagagaaaagagatgtatttggctcacagttctgcaggctgggaagtccaaggtatgatgcccatatcgggttggcctggggaggttgttcttgttgcattgtcctttggtggaaagcaactgagcatgtgagacagggaggaaattgggccaaactaattattttattaggagcctatttctgtgataactaatcccatgataatgacattagtccattcaggagggtagagccctagtgacccaatcatcacctaaaggtcctacctctcaacattgttaagattacagttaaatttcaacataagtttcagaggagacactgaagacacagcatctgcattcccatgtccatgtagctattcacaatagtcaagacatggaaccaaccttaagtgtccatcaatggatgaatggataaagaaaatgtgttatacatatgcaatggaatactattccgctttaaagaataagaaaatctattatctagcacaacatttatagatctggaggacaacatgctgaatgagataagccaggaacagaaagacaaatcccatagtcctgaagtcaaatttttgctgccacaaactgacgcgtccatggtggcagctatccctgatctctcatgctattcatgggtatgatacaacagtggccaacttcattctcatgcttttcacttcttgcctcccaccttgggggttttcaatgactgcttagatatgagacaccagggcacatgctcactcctcatgcatgtgtaatccagaaagggcagggagttaacaccctttggagtgaactttgagcaagggctgttagaatgtgtagatgcatttttctcccttcctctccctggatgaactcttcacatttataataacgtcagttggcctctttgaagatgtcctgcaaggctaggcaaacagcttcgctaagctggacaactctatagtacactccattatatttgtttccccttacactccttttccttcacttctgctgttttgggactgcgccatctcccaataaaatgttagcacaagatgcttttgcaaaggcttttttttttttctgggttaagagcagggactgggctgtgaaggagagccataggctaagatgataggacccacaattttcttagtgtctggtagtaatcccaggtatccatcagttcaggaaggtaggtagaaactataagtagattaaaacagggtagcaagaaggacttctgaaaaagtagtgagaatagatctgacagcttccacctttatggaatgaaagcttcatcctgtagattggttcttgtgatgcttatttaaaataaatttccttaaatgaggcccaacatgaaccaattctccacccctgtgaaaattttctattgccagtttgaacttctatgggtgatcatacaatcgcatagcttctgaggagctaactttcactcagaacttaggattcatctgttgtcacctcctctggggagaactcactggcccctctcctttctgccagctgttgagaatattagggttccctcttctgtgtttcagaggtattttctcatttctatcgtggcacattttatgctgtttctgcacaatgcagagagatcctgaaagcagagaatatgccttagccactgctgaatttctagaaactaacagaagcctgccacacagtagccatttaacatggattgattccattgactaaattaaagaattcatgaggagctctgatcatggcctgaggtttgcagttaccctattgaacaaatcccagaagagaatttgcggaattaggtctacatgtaatacacatttacccacatgatgaaataagatgacaagagctttgtggtatcaaaatatctatgtctctgacaattttcacaactttacttaattatattagggttaagtattggaaagccttgatacaatgctaatttggaagcattataccaaagtgttagatcagattagccccagttctcttctaaatagttccagaaaccagatttggacccagtcagcctaacggcagtaaaaaccaagacctgtctatcatgctacactgctttcttcagatgacaggggccttaagagcaaagtaagatattgattggcctccaggatccaggaaaaacaaaacaaaacaaaacaaaaaagccagaaagaatacaaggtgaaggcaagactgaaaggaaaatagttttgatgtactaggaaacaaaatcattgaatctgaaacactgttgtctttggaatatcctgagagaaaggagcccaacacaggtcatttggctggaaggaagatcaaggcaggagtccgtctggtgcgtggggttctccatgggagactgtcaacagctaagggcagcggagggcaatgatgaatgcctcagagccgagggccacagaaaaggcactgggaacactttccatgcacttcatacctatgactgagaggatggcctaggcaacctgctttagggtggaaactatagttacaaagatgagcagtcacttaatttactaatgaatgaccccaggtctcatagcttttctttaggaaggattatatagtagttaaaaagtgcatggttcccagatatagaaaaatctgggtattcaccttggctgtaccatttactgtgtgaacatctcaggctactatctttacctccatttgtctcagctggcacctccttaaagcaaaaataataatattacttcagagggttattgtggacattagagaaatatatgtgaaacacctgtccaagtagcaatggtgagtgtgcaatgaatactagttgtttatcatgtgattattagtctaattcttgcaaaatgtcccagcctttgtgttttgatgaacaagaatatatttttaaaaaattaaaaaattttgttgtcctcataatatagacatctgctccctgggacctaaaaagcaatccataattttccaaagctgctaaaaaatctgccatgttctaaatgacctttatcaagcgatctcctagtctagagaggcggaggagtaacttgaaggtgaaataccccgttagcaatcccccaggtgaatagaaaatttaaaataatattctaatgattcattgtacattactacgccccattaggtgtctacattacatcttggggcacaatcaatatctgtcatcctgcttatggttttggtgctagagcggttcaatttcattttgcaactctcatgctcatgaagctgtatctcgggtgtcatatgataaaatattactcagaagtacgtattcagtcctaaagcatagtgggaaataattgatgaagaaagtgtctttccatctggtcaaacaccattaaagtgaggatacgatttatatgagaaaaaacgaagattgatattccttttttttttttttttttttgagacagagtctcaatccatcccctaggctggagtgtagtggtgcaatcttggctcactgcaacctctgcctcctgggttcaagtggttctcctgctttagcctcccgagtagctgggattacaggcacgcaccaccacgctcagctaatttttgtatttattttatttattttatttttttagtagagacggggtttatcatattggccaggctggtcttgaactcctgaccttatgatctgcctgccttggcctcccaaagtgctgggataacaggcgtgagccactgcacccagccaaaagactgatattttatgaaactttttggtaaatccacgtgagagagaaagtttttattctgtactcaacatagttccattacaagcatttttcaaacatttaaactggattgctacttacaaaattttaatatagacaagactagttcatgaacatatcccctttataaatacaggtaccagtacgtagacatatatttcttgtatttaaaatttaaaaaatcatactacattttagaatatggcaaagcttaagagattccaaaacagtcatggataagtaataagtcacttgtcattgttctatacaaaattaatgaatgagttaagtaacctatgttttgagctgtttcctttcagaattgaaatgccaaaggagtgaccctctttttctcatgtgggtgcacacaagcatactccaatcgaaatatcttccccacacattctaccatgtggtagtacctagtaagtactaacctactcactaggttagtagagacttgtattagaattcagacatccttgggagggttaaacccacgatcaagtgactcatactttcacatgaatttttgaaaactttaaatgtatgatttctatgcaaattgagatcagactaagtgtgaattctacttaaaagagaggatttcggagtactgtggaataggacatgccaaggcccttgccacagcttgagacagacagaagatgacataaaagtgcgtgtgtgtctgtgcaagtgtgcgtgtgcatatgtgtgaagtataaagggcccatggagggctatagagatagatggataagagttgaaaaatggatttaacttggactgctcttctgttcaagatgcttttggctgctgcaccctttgcaatggctctggaaaatcaccaatagcatggggcttcatgcacagatgctctaagtgctactcgacttacccaactttataaaaggagggatgtgcacagctagtacatctgtgatatttgctttgggatcagaaatactaagtgggacagtggttttctttgatatagggagatgttcaccttaaaaatgactggaaaagtggcttgatttggtcttcaatatctaatcatgaaatggatatactttataaccagggtatatagtttgggagttttgactgattataatttatgtcatttcttttaaaaggttgagagattcaaatgccttgatactgatatatcaatgacacgttggagatgcattttttgggttttagcatactgaagtgaaagtcagtcaatagaatatacattgattccagggtaaatgtcccaaatttgagaaaagaggttatcctgaaaggggagaaattatctcacggtcccaaacaatatgttgtttcattacactgtttgtgggacaagaagggaagggggttggatgcaggattaagacaagtgaaactgtcacatagaaacatgaactctggttgggacaatctcaaaatgctgcaggtgtttgtaaagcttgctgagattgactgggctctcctattacttacttttgatgctggattttgtctgacttttgtcccataaaaaataagacactagaaaggctttttggtttttataattattcatcagtttctattttcacatagctttggagcactgtagaggatcccttgtatattttagaatgcctatgtgggggaaagaatcacaagtagtaaagagcttaccttgatttttggaatagatatgttttaaccaagtgtagtaaagtgaatattctactttctagtcatttgttacagaatcaggcactactacctccctactgtcacagtaagtagctgtagtctttctataacttaggactggtgtggggtgatttttgatgggtaaattttcaacattcttatttcagtcctgaattttagaattttgttgacatacacaggattcttcaatagccttctatttagtcttctatttgccacttcttatttccaactcatcttatatgttactatgagacaaatgttcattaaacattacttttgtttgtttttgagcaattgcttcttgaagtgccagttttctattgctcttgtgtataatccacttttctctttctggatttgaaggtcatcctcagttttgctccacttgatctcatgttaacttcctgcccctccttatcatgaaaagtactccagcctgcaactaagcccttctcctcaccctctatcgttgtctctatgcctgccttatgctattgcttttcccaagagtacccaccccaccctcttcttcctcctttttataccttactgagctttaagtttcaccttaatttctacctgtataataacaaagtagcttgcattcattgagactccacaataggccagccactattctcaacacatgtcatgtatatgttgttaaatgttgatatcaccctattggggaagattcttcctctaccctctaagggtctctggcagtacctaagaattaaattaaactgaggtggctgggcgtggtggctcatgcctgtaatcccagtgctttgggaggctgaggcaggcagatcacaaggtcagaagttcgagaccagactggccaatatggcaaaaccccatttctactaaaaatataaaaattagccgggcatggtggcgggtgcctatagtcccagctactcgggaggctgactcaggagaatcgcttgaaccggggaggcagaggttgcagtgagccaacatcgcgccactgcactccagcctgggcaacagagtgagactctgtctcaaaaaaaaaaaaaaaaaaaaaaaaagaaggaaactgaggtaacacagatcaacaggagaatatcatacacaatttgctaaaattttacatatatgtggaagtccttacaaaacaaaataaaaaaatatagacccaaagaagtgaccaaaacagatagcttatataccttttagacaaagaaaggataaatttttaaagaaatgataagacaaagggatttgggctaggagcaataaattgtagggaagtaactaacagatatattggggaaaactagtagaagataaaggttattttagcaagcttgtttgaacagattcatttcagcattgattcccagtctctggtgattagagtgttcctcttttcttggtacagggagagcacctttctcaaatgaaatttatgtgtttttttttttaatggcccatttttaggtagcaaaggggaggtcagagaccccttcctgcatctgctgttcctcaagtatctccaactcaaaataatcaatatgcccaaatagcatattttgaggtggcatgtcctgaactccttcaaactgtataaggtagttctacatctccattttacaaataatggcatcaaggcacaaaggaataaactcactaagggacacagttgtgaagtcactccgctgggacacaaagccagctgcctgccccacaccctgttctctctgccactctgctgcccttcccttcagtcttctcggactctccagctcattctgctttcctctatctatgaacttatatggtagctgttttcaaaaccgtacagtttatcatttcattgtgacgagttcatgcatgttagttttttctgagcaattacatagcaagatatcttgaaatgatttctatgcctcattctactttctttccaaagcagtcctggctcctggtaagaactcattaaatactttgtgattgatagataatacaaataatagagataggaggcaggggaattctgggcagaagaaggcaggtccccggcaagggccccaacctcaagcctgaaaccacagcccaaagtgagaacatacatacctgttttcccactcaaatgttgccttttccaaaaccacccatggcctgtcccactcccaatcctgtgcccataaaaaccccagaactcagccagcagagaggagaagcagctggatgtggaagactatggttagatgtcagagagaagtgacttgacttcagagggacagcttgatggcatagctttggagaggaatccggccgttcctcctccatcccctttccagctccccttcctgctgagagccactttcatcggtaataaaatcccctgcacttaccatctccaatttgttcctgtgaccttattcctcctggatgccagacaagaatttaggtgccatgagtgcgggtacaaaaggctgtcacactgaccttccactgagcttttaacacttaagccatccagccatccacagatggcaaagttgaaagggcactgtaacactccttctagggcttcaggtgttgcaggcacccccctagatgctgctgtggggtctgcacaaagttttgctcctgccggcacccaaaaacactcatcctggctcccgtgtccactcacctgctctccccctcccacaaaaggtggaacacaactgggccaagcaagtggagtctgaccctgccagcaccaaaggagccagctagcctgtgaaggcatcagggaagtatcatgcttcacaaagacagctctcctcccctcctatgatacaaacaattgtattgatttttgtaattcactctgactatatagaccaagtgccttcaagcacggtgacatactaaaaagtatacatttcatgtgactgatctacaaagtagccctcagcttagctgagagttgactagcatcctgcaatggtttctgagttgggctccagtgggtctgaattattcagttttcttttttttctttttttttctttttttttttttttgagacagggtctcactctgttgcccaggctggagtacagtggtgtgatcttggctcactgcagcctccacctcctgggctcaagtgataatcccgcctcagcctctcgaatagctgagactacaggcatgcactacaacaccccaggtaatttttgtagtttttgtagagacagagttttaccgtgttgtcccggctggcctcaaattcctgggctcaagccatccacatgcctcagcctcctaaagtgctggcattacacgtgtgaatcactatggccagccttcagttttcatttgcattgttctgaaacaattttttaacattccatgttatacaaacatcacacaaacaagaagattacaccatttgtgatacgtacgtggttatagttcacataataggagacactattcaactaccttaaaatcagcttactgagcaccagaaacaacatgattcatatattggcttaaaagtccagtatcactgtgattttcctgattttttctttttttaaaaaaaaccatatgatgattatgacttgaggttctatccgggattgatactggaataattcttgaaggttggtggttggggacagagacctggtaatcaggcagacctgatttggaatctcagctgtaccactgattaacgtggcaattttagcaagaaacttagcttctctgaacaactacttcttgatatctaaagtgggaataataacccctactctgcagggttgctataagaattaaattcaataatgcatataaaggaattatactttctaccacatggtaattgctcaataaaatgtttttattagtggtaatcatgtatccataagcatagtaattgatatatgctgactcacctgaaaaaatggcaagtagaatttggaaatgacagcctcttttcttccttttttccttctttgcttccatccttccttcctttcctctttctttcctttcttcttttttccatctctctctcctccttttctttctctcttctttgtttctttctgaggcataatttacatacaataacatgtatttattttgatgtacaatttgatggattttggtcattgtatgcagtcaagtaaacgtccttacactgaagctataaaatagtgccatcaccctaaaacatttcctcatgtccttttgcaatcaactcctcacttccattctcaacctcaggtaaccactcatctgtttttgatcactatagtttggtcatttctagaattccatatacatggaaacgtaaattatatagttttttacattcgatttctttcacttagcatactttttgtgattgactcatgttaagtgtaataatattttgtttatttttattgctagtaatgtttcatggtatgaatatatcacagtttgtctattcactagctgatagacatttgggttgttttaatttttggctttaggaatactgttgctataaacacttgattgcaagctttcgtgtgaacttactctccttacagggcttagtgtgcccagaaaaaggacactgggttacaatgggaagtatagcacatcagagcatctaagttgtgtcttctccttgcctctagtgatgataatgagagtaataaagccgactttcatttatctagcctgtttcctcctctcagagaggctgctttcacagcccccactgtccccaaagagtcaggttagcttgtccccatctcatcactggttcattgagctgtggtagacacctgcctcaaactggaccaaatggattttctaccctgagaacgtgaaattcagaaacagggtcttttaaaattaattatgtatgcttaaactagaggtaagatagacttagctaggatgggcaatttgagtcgaataccaagacaaccgacatctccagtgtgaggaaagagacagcgagagtgagaaagagagagagagagagagaaagagagagagagtgaaactgcagataagcaatgaaatccagaaataagagactagatttcaagacagagaagtgagctatatttatttcaccctctttcagtactgtaagatgccacaaaatcctttaaactctgtggttttgccagatgctctgaaagtgttccagggaactctctctttggtttgaactaggttcagcaggcttttgtttctgacaaataaaataaccaaataatccctgactgagacaaatcataattgttatgaagatttgttgaatcctaactacctacctactttaataataattctattaatcctttcttacatcggatcaccaaaacaaccctgtaaggaaggatttttctttgaaggaactgaactaagaaatgagttcagttagtcgagaaattaaataatttgtataaggttacatgtttggagggtagcaggcctggagactaaattctgaactgcttttccccaaggtctctgatggaaatagcagtcccatgctggaccctgggtgtgacatgaaggagacagcgtagggctccatacagctcccccagcttggtgatctctctttatatatctaagaaagtgagtggagtaataggcattgagagggctcctgtctatggactccactttctctgtgaatctagattatttgctgttaataagggaagatttgatagtgttggatatttgaaggaagtcatttgtgaatgctatcagatgccaatttggaaatgcagaaagattataagccagtatggtcctataaggactatatttcatgtaagtaaagttgagagaaatagagacatttccctcttaaatgtttgcctgttggtttgtttttacattcattttgtggaggaaacacatgactttaaaaaaatgtaaactatttctgtttcttcttatgagtgaatcgtggtgggaaagacttcatggacagagtgaaaatgaaagaaatgctttctaaagcaaaacacagaaaaggagaaagctggctaggaggtgataaggaatatgaaaagactccaggagttataagagagaactcagaagttacagtgattcccctgcctggtgggcttcagaagcatttgtagaatgagtgcagcataagttttagtcatgcaatttggatgtgaatagagactttgcactatctggcctttcaccacttccttttcttttctcaacttgggccttctcatcagaaactgaggattgttacacctcacaggctagttgtatcaactaaatgggctgtccaggagtggtggctcatgcctgtaatcccagcactttgggaggccaaggtgggtggatcacgaggtaaggagtttgagcccagcctgaccaacatggcgaaaacctgtctctactaaaaatacaaaaattagctgggcatggttgtgtgtgccagtaatcccagctactcaggaggctgaggcaggagaattgcttgaacccgggaggcagaggttgcagtgagcaagactgcgccattgcactccagcctgggtgacagagcaagactctgtctcaaaaaaacaaaacaaaaaaacaaaaaacaaacaaaaatcctaaatgggttaatgcaagtaaaatactaagcctgctgatatagagcaggtgctcaataaatgtcaggtttcctatcaccacttcatactgttctttgagacattcattggtttttcaactgtttgcctttaggaggatttcttctggtctggacaatcgaagaggttcacagtgatgcacgtcatttcctggcctacagtgaagtgacaattgtacactcaaacacaaatctagatgtaaatatcacagacttatttgtagttattaatttaaattggttaaaacaccttcttagttacagataccaaagagcttaagtatgtggtttaaagcattagacgcaaaaggtattacagacgcattcagggatgatgggtatccccggatcctaaggcctagtgaatggtctcttctgtagaagacagagaggataagagtggggactaacaattcaatcttataccaaagataaataagtatgtatagatatcaacataggtatataggtatagataaataggtataaatatatatggatatagttctaaagcatactactttacactctgcatacaaaatatattagttgatagctttttatatttagccttgaatattcttttgtgcagagagactttataaaatcaatgtgactccaagaaagtattagcaggaattcaggccctgagaaagacaagcttatggagcaggtaaaaagtttcataattgggtcctccagtgttgtgctaaatacagacagaactgtcagagtaggcttttgacatttgcccatttattcttgcactaaaatgagcaatttaaaaacggttggaaagaaatcagtggctatttttgaacaccatcctctgaaagtacagcagataaaaacaaaacagaacaaatatatggaaaaatatgtagctgatatcagggaagcccaaaaaccaccttagagttacacattttccaagatctcaactgagcttctgaaccactcccagtcaaatcaaactcgattatttgtaaagatgctgtctaatgatcagtagaaagtgaagacacacaggatatgtctccatcagctcttaacacacgttggctcccaaaccttacaatagctcaaacttctcctgcaagtttgatccacaaagtgatcctgaactaacacgagcagcccaggcatgatggcatcaccccagaacagaacacttcctccaggcatacattgtctgtgagcttcaaattgcttcttgtcctgtattgtttccagatgatgagttttccataaatgttgtctcttgctagaaaatgttatattccagcatctacctttaaaggcaactatcaaaacaataatctttaaagatctgcagatgcctgtggagatgagactcataattactctgatgaaattgttgtctttgaacatagcaatgaagagttatttttatttgggaaaaagtgtagaaataagaaaatagcatagtaaggctgctcttgactttcgtacagcttcagccttttcatgaaacataactcagatgatcttcttctgaattagtgaaccctgatgttagttatataaccaggggaccacggtgtcagccttgttattttaagggtcttttccagtctgcaagacccaaccaatttccttcacctttcacatgtggacttctcattgttactaaactaaccatcccttcctgctcatctctacacatactttaggacttattgatttcatggacgttcatttgtctcacaaacttggtgatatagaaactgcattttctgctttggtgcaccccttagagagcctagtgtggttcagacaaacctgatgagatgcacaacttggaggtctcgattttctcatctgtaaaactgggcaagttgttataaggattgtgatactatacaggaaagtgctaaataccgcaggcacagatgaaaggaaatctttccctctcctggcacaatgctacggatgcaaacaaacacattgttttacctttacatatcatgagttacccagagttttctcgttcatgtatgaagggagtactaattcgtcatcaccaaagcatgagcatatttagaactggattttgagttttgtaaagatgtgtaaacttcccaggtgccagtagcaggcctgtgtagatgttgtcctcatcaaggatcagggactgcttgttgtcacgttcctgttgaggaatgcctgcacctctgaccagcctcaaacactgctgtagaggaaagattagaaatataaattatgtaaaatgcagatcattgactgaacatttgactgttcaaggagttgcattttactgcttggaataccttttaaagtgaaggagaagaaaaggaggaagggggagggaagggaggagaaaaagaagaggaggaagttgagaagagggaaagttgctccataatttacaaggctctttttttcacagtgggattattatttcccattatcacatgaaacaatcttcattacttttcttaattctgtcttcattctcacttcaccttgtccttttatatatgttctctcaacttgggaataagaaactggacctttacagctgggcacggtggctaacgcctgtaatcccagcactttgggaggccgaggcaggtggatcatgaggtcaggagttcgagaccagcctgaccaacatggtgaaaccctgtctctactaaaaatacaaaaattagccaagtgtggtggtgggcacctgtaatcccagctactcaggaggctgaggcaggagaattgcttgaaaccggaaggcagaggtggcagtgagccaagattgcaccactgcactccagcctgggcaacaagagtgaaactctacctcaaaaaaaaaaaaaaaaaaaaaagaaactagagctttacgagaccaaatatatctgaatatctgaggctttagaaaaacagaagaaaggaaggaagggaggaaaaagaaagaaagaaagaaagaaagaagaaacagacaaaataaaagctttggaattgctatagaaaggattagattagatgactagctaagaccttttctcgtgtctgtatttggggaagagaaggcatgaatttccccttttagttaggtaaacgtatttttatattgagaacctcttgcataaggacaggtgaattaatatactcattgaaaatgaaatgacttcagagctcaaaaagatcttgagaatatctggcgcagtgtttttgaaacttttaagaaatcagcataattattccccccatttatatttcagttaagtaaaattgactctaagtgcataaaatacgggaaacctggctactagggtttgaatcgaaagcagggtttgtgttatccaaggcatctttcctccccttcgctgtccttctctttctccaaggttaagtctgaggagttttctagaaaacctcaaattcagtggaacacattctacctccatcataatgtgaaaagaatctgtggtctaatctgatgaaataatttgctcgtggctagctgataaaaagcacttgtagctaacacatattgagtgatgaacctggactagatgcatgaagtacctaatctccccaccaaccctgtgatgtacacactcttatgacactaattttatagagaaggaaactgatttcagagagcttaagtgattagaagcaaatccatgactagaccttggtgtccttaaccctcagggcaatgctttggcactctacaatcttacctcctagaaacaccttcaaaaccaccctatgattagaactgaattttagcatctacaaaaattcacagttcacttttagttctctgttttcctgggttcttcccaggaatttaagttattttgagaccagagaagcttaaggcattgacattccacatgccctcaggatttaacttaagctccaggctgtttcaataccaaagattttgcctcaaactttgccaccactgagaacttggggatgtgaaaaccactgaggcagcaatggcaaagagaagagtgggaaaggcctttccaggatccatgtgcagaattagatttgtgtaccacctgtgataactgggaaagatcttttttttctggtttttttttttgttcctttttttttccacgttggaggcaggaataaagcaggtgagggttccatcagagtatctgccctaatttcctgtaacagcaacaggagttacccattactcctattgccaatagatatcatggcttcactcctaaaccatactcagagcattcacttgttgatgttagtaaggaaaagcaagttgtgcataagcagtattatacagcatgcttcagtacagtttgtagctatttgcttaactgaaatctaggtacaagcctcttcaaataacagatcttctttttctgtatgttccttaaagagaaagaggaaagagaaaagaaacatgcctggagtgagcatttatcaccaagacaatttccaatttcatctcacgatcaggtttacttcccaatattctacaaccgtaccattttatcatgggcataaacattgagaataatgactcttgtgtcttttcagagcctaatttgtgatgagagaattttaatgttggaaacaaactttaaaggtaccgaagtccagacgtctaatataccctagaatctctctgcagctcgttggcaacagacatctggcccagctgtgatgctctaataagtccaggcaagaggaccatagcactttagaaagacatgaagcttactgaagatatgacttacaaatagagcttttggtacagtgcagtctgaaactgattttcctaaaaataaaatgctcacgtaggtctcaaataaaggtgcctcgctcctcagatagatagaaaatagtacaacacccaacctaaatagtcaaaataaaaatattgtgtatccaaaaaaaagttttagaaatgtatttagttaccacttggagccagaggtagttgccaacccaatttcattataagtgaaatttctagggtattaaaaatggctctcctcttcttcttcctctcccttttccttcttctttttctgttgattttttatcatttaattttgatccacaattctgtataacatctacatctcatatcaacctttttttttttctagaattattctactccctgggtcagtccccaagatgtttcacttcattatggatctccttagcgctggtgctaaggttaaaacattaattctccgcatgctgagagttacttagctccatggtgaagtctctatctgccaaaagtctctgttcaaataaatatgtaactggtgattctacagcatgcattagaatcatgcagagggtttgttaaaacacagcctgctgggccccaccctcctaagtctctgattcagtggatctgagggagcccaagaatttgcatttttagcatcttcccaggtgctgcagatgttactggctcagcaacaacacttagaacaactgttctagaaagagagtccctagaactgttgcattctagttaaagatggtgggaatgggaggaagacattgctctataccaggctgttatgggcaaattcgggagataattgtgatgaggttgaaaggtttgaatttaatctccaaatttcagtcagagagtaagattcattaaggcttttttccatccccctgcaaagtccattcttccagccagctcttgctccagccctgctgtgatgagactctgctgttttctgttttagctacttctgcagctctcccaaccctggaaaagatgaagaaagatgatgattttgttctcagctcttagtctttagcctttggacagccatcaaaagtacattttaaggaaaagggggaaaatatgtctactaggagaaatgccttgtattagactattatatcagtgatttgcttttacttaatgtagtattgaggagaaaatgcctctcttttattattcaaatggtttgcttttactttaccaaattacaagaaagcataccaaatgcaggcttctaaatagtttaaactggtttaccacattaaactcaaaagagagtatttcattaaaaaatataaatggactggagctgttttctgacaatacactgttgggctttttttaaacttctacttttgttttatgaaccgaactactggtgtttaatactcaaagatgctcagcttttaggtaatatttgttgtaggaattcttaaaagccacagatactgctaatggggaaaaaacaacttttcttatgttgaggttatagcaactttggtggataacagttaatacaattagttttccatcagtttctctaaatgcattttttttttctaactaactttagggtattctgtatccttggcattgatttagtgagatcttcattacatggcatttcactttagtttccattgcagattgatatcacaggtaataactgaatctttagggtttgaagaagctgacctttctttaagagatctaatcatttcacggacaagttccagtggtatttctattaagaaatcagggtatggctgggcacagtggctcatgcctgtaatcccaacactttgggaggccgaggcgggaggatcacctgatgtcaggagttcgagaccagcctggccaacatggtgaaaccccatctctgctaaaaatataaaattagccaggtgtagtgtcacatgcctgtagtcccagctactcgggaggctgagacaggagaattgcttgaacctgggagacggaggctgcagtgagctgagatcacgccactgcactccagcctgggtgatatacagtgagactccgtctcaaaaaaaaaaaaaaaaattgtctgtcttcatggtaagataatcaggactttaaggaagtgtgtaagacattttactcatatttttattaccagtttacattatggtttctaaggccattatgtgaatccaaataccatcttgaaatgaaaacacattaagctatttttaatctgcaaattatttgatcagctgcctcagatacatgaagaatctgatggcaagggcacagaatagctaaagtttaacgggaaagctggtactatccaagtcagtgaggtgaacacccagctgcagagcggaggctcagaaatggtgagtgccaagatgaatcaagccacaaaaggaatgtggaggacctctgaggtttagcttcatatattgggcaatgtttctataggcagtcattggcctttcgtcttcgtcttctgcaccgattcagtcatttcatttgtagagtcttcctcaacatattgtttaaaaaaattcaagatttttcaaatttggttttaggatttcaaaaacaatcaggactagtatgagctattcattttttttttttttttttttttttttttagatagagtcctgctctatcacccaggctggaatgcagtggccaatttcagtttactgcaacctctgcctcccaggttcaggtgattctcctgcctcaacatcctgaatagttgggattataggtacccaccaccacgcctggctaatttttgtgtttttagtagagatggtgttttgccatgttggccaggctggtctcaaactcccggcctcaggtagtccacctgcctcggcctcccaacgtgctaggattacaggcatgagccaccgtgcagggcctattcattgtttttttgttaattctctaaggattaacttttgggccatgttggactgacagattctgtcctttgctctgcttatgttttcccttctattttcaggtagtgattaagactgtgaagacagaaggtctgaattagcaatttttcaggcagctgacttaataatttagactaaaattcgttccaggatgcttgctcacctcctgcatgtggtgtcctagaaagcctcttgtttctccagctgtcctccccggcagcattggcatcacctgggagattgctagagatgcagatcccaggccctcgcagatccatggagtcatcacctgcattttagcaagagttccaggtgattcgtgtgcacattacagtttgaaaaatattggtaaatattatggtcatcatagcgggttatccaactactggttttagctctgccactatctaattgtgtgaccctttgccagtcagctcagcttttcaaactgtgtttcatggagctgtatccattcagtttattactcagaggctgggtagtaaggtcagcagctcccatctgagccctgagcgactccagttttattagtttttatctgttaggctttaacttaagacactgtttgaagaaaaggtttgcctgtgaaagagatcgaaggcctactgtctctgatgagtcttaaagtcatttcctgatctgaattttctatgattataatatcattcattgataggaattgtttccttagcgaaaaggaaaaatctcttcatttctatacatgtggcaggttgacatttgtcaggtactgaggctgacagacagtttagctacctttaggaggttccttgatcaaaatagagaaactttgccagccactgaacttctcactgttttcctcatcttagcgacttaatccaggcctcaccccatctgtcactacagaagaactgtttacgagacctcactttactagcttttatttattttatcagtgttggttatttgggagcaaactgaccctgagctatcctttggccagtgccattcactttgcatacattgatctaaaaaggcaattgggttccgaggtctgagatacccaatgatattctacatgtgacaaagacatttccagtcctgcacaccctggtaacctaaagaaggccaagcatctcaattaattttcagttgacagtttctgcagctgagtccccaagtcagagtccctaaacaaaattgtttgcattctataggaaaataggacacattattagcccagttctaaatccagttccatctttcctcaaacaacagcaaatgttcttctcagattcatagcatggagcatcatccacttttaatgttttccatccacatagctgcattgccctgttacttatttacaaatttattggctttagatggcatattttctccaaagaactcaggcagttgaatgagttgttttagaagtctacaaaatatacccttactcattcacctgtgggatttacatgaggttatttcacattcctcttcatgtattgcgatggggttgttataaagatactcacacctttaaatcttcccagtagcacgtatatttctgctttcaaacacaacaaccaagaaaaaagaaaattctactgaaacaactgaccaatcttctttccttagaaaaatcaatctcatcagtagctcatgaaattcaatttccctggtcaggaacaaagcagataatcatcccctaataatatttatggatgacagaaatgcagagcaaataaaattagcctctaaaactatcatcaagttccttgaaacttttttctttatctcaaggggatttatggagtaatggtaagtgtgtttttctccatttctatttaggccaacacacatcagaggcactcaatagatatctggtgaatgaatgaggagtgagtaaatgaataaagtaaaatacagatgaccctcaatttggacataatgcattcctagagactgcttcataaaggatattgcttaaaggcaaaacaccgactgcaagaatgccaccacttttgtctgtaaaattcattacaaattgacagcagataaagtagcatatatatctcttcattaggtaacagcaaataaatggaaaggcaaaagagggccacaatgaagcatgaacaatgtatagaattctagtaaaagatgattgcataaggacatttttaccttgcttctctttatgaaagtgtccatcaatatgaagaaaaagaagggaagaaccaccatcttctccatgacagcatgcctaaagctagtctaatcttctctctgtcttgaaaggttttatggatcctgtgagtctgcttatcacagtcatttgaagagagaaacaacaactgccaatcatgaaacagaggatgtgtgagatatgggcttgctgtgaaccaagatgatccaaaggggatgctgaaagcttagcagaaccaaatactcaaatagaaaaaatgtggctgatttgcttcaacagctttccgagataatataccaaagtggaaactgatagcttctccagatcatacttgctcattctgtccccgattcttgggcagaactctggtctagagagaactttccttattccaagaagcaccgtgagcagaagacctaaaacaagacccatagagtaaagggacatgggaaacaaaatggcaaatctgacatcagaaaaaaatgaagaagaaaataaataaaaaatatagccttcatacttttaagtaaaatgagtgtaagctagttgcaaaagacataaaattaataaaagataacaacttaataaaagatatcaaatctaatctgtctctctcacatgcacagacacacacacacacacacacacacacacacacacacaaagtgttgaaaggataatcaggcaggccgattttaagaaataaatgtaaaaataaagtcatcaaaaactgtcaccgcattaagaacctaaaggattaagaaagacaacatagaaaatagcatccatgagcatagaaggcttgaaataatcacagaaaaagaaatgaaacaaaaaaattagaaagcgattagatacaatattatagatatggaagtcagacatagaagatacaaattatgatataaattatagtctaaaaagagaaaaatataacacaggaaaatttaaaatatttgttaaaataacatctcctgaaatcaactaaaaccagaatcttaatgttaaaaaaaggtctattgtgttttaggaaaattttatgtgaaacatctcctgatgaatagaaagtctgtggccatccaagcagaaaaatcaagctagtctaaaattcttcatggcagaattgaatgccagaacacagaggaaaaattgtataattatagatactattatccaaggtttttttttttttttttttttgagatggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccggctaattttttgtattttttttttttttgagacggagtctcgctctgtcacccaggctggagtgcagtggcgggatctcggctcactgcaagctccgcctcccgggttcacgccattctcctgcctcagcctcccaagtagctgggactacaggcgcccgccactacacccggctaatttttttttttgtatttttagtagagacggggtttcaccgttttagccgggatggtctcgatctcctgacctcatgatccgcccgcctcggcctcccaaagtgctgggattacaggcgtgagccaccgcgcccggcctatccaaggtttttatacccagtcaagctgttcttcaatgtaaaggctatatactaataagcaatctaggctataacacccatgatccttcaaaaaacaaacaaacaaaaaaaccagctgatgaaagaacctaaccatagaagataaatcaaagaactctgggttagagaactcattgaattggtattgaatctatatatacttagagataggactaaaaaaacactctgggaattatgataatagaaatataaatattacaaatgtattactgcatctttatattttatttttcaataattatataatcagcaactgggggaagcagttaagactttaagtttggggagaaatgatgcctctgattggtctttttggggtgtattaatccattcttaagctgctgataaagacataacagactgggcaatttacaaaataaagagaggtttaatagacttacagttccacgtggctggggaggcctcacaatcacggcagaaggcaaggaggagcaagtcacgtcttacatggatggcagcaggcaaagagagagaacttgtgcagggaaactcctctttgtaaaactgtcagatctcctgagacccattcactctcatgagaacagcatggaaaaaacttgccaccatgattcaattacctcccgctgagttcctcctacaacacatgggatttcaagatgagatttgagtaggcacatgcagccaaaccatattgggggtgtcttaggttaggttctctcgaaacagatcctgagacaggaatttgggtaccatggttattgagtgagtgctccttagaggaaggatgtggataaacaggatggggagacgttaaatgaagatgtggtctcagcttgagtccagcttcagtctgatcccatagagagttctggagcataaattgaaccacagtgctagccccattttgaggtgaggggctggacttttgttccctcctttcaatcagtcattgactgcaggctgttcaatagggaagggataaataggggtgtaactttagagctagatggctcgacttccatgctgggtaattccctgaaaaagagacagctgggggctttagcaccagcacccacagcagcaggggtctgggtgcatcagtctgtgaaagcgaatcttggcagtttcccaatggtgtctcctgtagagcattgatagctctggttgatgttagctttccctgtcactgactggtcctttgttatcctttattatggcttataaatgtcagttttcagtgtctgaatgcatttcactgagagaaggaaagaaaagaggcgctgtagagggaaaaggaagtggggaaaagcctagactttttttaaggagaggaaatgtgccagtgagctttgtggaagttgtttcagcatggagcagttatacatgttgccagatgtggagtctcaacaatctcagagggtcagcctctttagctatgaagtgttgctttatgccctccagaaattatccctctctcccctccacctgctgctcatcccatcccccttttctctctactcaccctaatgatccatctcacaagagatggcatgtctcaaatggcaagaacaggaagtgacaaacatagacagtgttggtaatatcgaaatgaaaagaaataattgtctctgattaagatgagactagaaagacattgacattgctctttgtagcatgtactagggagcacccaaatctctaagagaggactaaagtgtggcattttgcaaacttactttacaattgtacccattgtctgttgactattcagtgggaataacattctacaaaaacattctttagcaaatgtggatgtaggcaatgagatccagggggttttcaagaaatacaggtgaagatgacatttgtgctttagcaataactcttaaagaaatgtggaggatgggttagagaggaaacagaatgtcagggaggccagtgagggctatttcagtagtctaagtaaaaatattaaagtcctgaactaatcttagtagttattaaagcaacctcccagataacgcaggatcccatatccctgacagaagagccactgatgcttctgtgtccatgaaacagctaataaaaactgatgtttgagcctaagcattaagaatgttttcctgatagggagctaaaataatctttgaaaatcacacccaaaatattagtcctgccctttgaagctatgcagaacaggttgcttgttcactaagaaaaagatgtatatatcaagtgctgtcttacaagtgggaatacaaaggtgaggaaggcatagccgtagctctcaaggagctgaatatctagtgagaagaaaaagacatactcaagttttgttgcaataaatttcagcagaggaaagctatagggattttagaggaagaggtgaatgactgtccaggcatgctaagaggattcatggtgcctttatgaaataatccttctgatataggagggaaggaatcaagtccatcctacccctacctcctgtttgtttgtttctcagtttgcccagttcttgaacttgttcttttattacatgaatctaaatttcattgaatcccattccttcttcctctggagattttgtacttttccaatgtttttctttaaatgtaggcttccaatcattggtcattgtctcagctgtgatctgaggaacgtagaattcagcatagtgtgctgggaagtggcaatgtacccaaaatgtgtgtggaaggcttgccagtatattagcaataccttccctctaccctttgagttctccttagaggtttaactcactttctaagcctccagaaactgtatcctatgttcctttatattgtattagaaataaagaattggttaaactcaaaataaatagatgttagtgcattaacacaagcctgtacccattataaaaatgtatttggcaaagaaggtaatgtttaacccaaagaaatatcctttagggaagggattttaggcaccttaatgtaaaatacacatttggtaaagaggccctcttcagtacacttgagtcacaccatatattcaatttctgacttcataagaggctaggtcctgataaaaatattgaaggaacacatgtgttaaaagtgtagtataacatctactattattggatgctacataaaaagcatggagctaagcaattctccatgtattatgatcatgcaatttcaacaaccactctataagatatatgctattatctccattttacagatgaggaaactgaggcttagaagtattgttcgagatcgagtgaaagaggcctagttttcagatcaagaaatttgattccagttttgattttatcacttactgtgattttcgcacaagtcatgttactatgtttaaccttttgtttctcacctgtaaaatgaaggaagatgactaaaccatttcttggggctgttccagttgtatgattttatgaacatctccatgaaagtatctttatttagcaaatagccaaatctgagaaaaaggcaaatttattagtctttctagaactctttagcatcctacctttaccatgaagcattactccacattggctggcctgtattctttccaactcctaaacagtagctcttctttcaaatgtctccctctatttaggcacaagcaaggtgctgaaaagcatgagaaatatgagcataatacaaggaaatcgataaggttaggaatcttcacacgtttaacttaatcatatcagacactgaaaacaaagtcatattttattgccaaagagaaatgctctttggcaaaccatgatagtaatctgattgtgaacaatgcttattcatcatttctggggcactggctgctgtgccagccaaggggacagctgacctaatgggcttgaagttgcattcctcaacattagttatgttgttgtgtgcaatcaccaacacaaagatagtgtacattggtcaatcagaaaatatgggctccttgcttgtttcccgttctgtttttattgacgattgggggataaattgcacagtgatagccaagagcataaattttctttgtacttttatataatcttgtttctcattttacaatatctgtatttattcctaaagttgagaagaggatcagacattacaaaacaatctggaaaaggtatggtaataatctaaaatatcccatagaaaacacctttatgtgttgccctaggtcactgaggcagttataacaaaaaatactatagactggatggtttaaagaaaaaaacagttatttcttgcagttctggagactgggaagtccaagctcaagatatggcagatttagtgcctggtgagaacctgcttcctggttcatagaagtctgtcttcttactgtgtcctcgcatgatggaaggaatgagagagccctcttgggtctcttttataagagcactaatcccatttatgaagtctctaccctcattacctaatcacctccccaaagcccccatctcctggtaccatcactttggtaagggtttcaacatataaattagggtgggggatacaaatatttagttaattacatgtgtatttatgtctcagagatgaggaggtcttagtttcaaatagttacacctatgcaattatcattccaaacttaacttttcctgtaatcctctccttttgatgtcataccatttgtacactgtgtaaacagttactctgggacatagtccataatttacactcccttttccttaattttactttgaggttccttctcagggcttcctttggactctgtggttacctctatcataactcttatcacatagaatgagatataattatggttgtgagatcaatctttagacgagagtttattgattgtttgtgactagctttgtgttaaatgtggggtcactaaatcctgcatacacttcttttcaaccaggtattgtttcaataattccctctatctctctataaaaaattgaattccttaaacccgggagtccttatggatcagagcaagtgagcagcacatcgcattctaccaatttagcttttttacagaatcccagtccaaatgggactattccgtaatgttctgtggtcgtaactgttgtccagtgtgattggcctggttttcttaggcatgaaacatgatgtattaattatgatctgaacagtgagccagaagttactgtatctagtttgacagtattaacatttatggcacatagttaaacaaggacttttgattctgaggtaggaggagttgggaagatatgagcagaatttttatacacgggggattctgattagaggatcaacaattacaaagtatagttatgcaccgtttaatgacagagatatgttctgagaaatgtgttgttaggcgattttgtcattatgcaaacatcacagagtatacatacacaaacctagatggtatagcccactacacacctaggttatatggtacagcctattgctcctaagatacaaacctgtacagcatgttactgtactgaatactgtaggcaattgtagcacaatgataagcacgtatataaacatatctgaacatagaaaagaaatagtcaaaacattgtgttataatcttatgggactaccgtcatatatatggtttgattttgtccaaaacgtctttctgagacacatgactgttgtctcacacaataaagagatagaaccttcataaatggagagtggagtgtcaatgcaaagtgggattaaatcaggaacttacttgaagacggaaagaggaggaacaccttcagcaccatctctcccatccttatcccaaaacactgatgactttacagccacctcccatacacactgcaagcacagggcactgcaagaagctgtggttacagaggagacactgcctaagggatcagtctgagtgccactggtatcttatggaaatacaagccagggactatcatagtcaatggaagaggattcgtgttaatgtcccacagtcagccagaagtgcttgtgactctatgcataggcacagtgcctttgaaaattgactttcaatcactttgtgagagtgaacactgttactgcagggtctagctgctccacccattgttctagatgggagataaaacagcctaactctagctggatgctcagtccaaactctaggatgagggtcaaggcagggactgcactattcattcatgtttgcttttctgggactcctataactgatgccttggatttgtgggatggttggttatgaccagtggctacacctgaggaactcactgtagcttgatggttcatatagatttgagattaccaaaatgttattcaacattcatactagatggtcttgaatatacttcaaattcagcatgttctcatctgaactcacatctcaacatcaccacactgtccctttcctttttcttatattttcagagtatcagtataaatctcattgcaccaggcagaatctgaggagaaatccttgcagctccttcttcctgattcatcatcaaagcctactgattttgcctccaaaccattcacttctgttcctctttacatatggacaatgggaggaactgactaaccacttgggcttgtcattctgtttgacccctttccccagatgtattctttgtcctctgccctattctgccttgaccttgacttatgccctccaagtgggtctggctgagaaataactggcaagagatgagcattgggaaggggagataggaaaatatttatctccatctcttgctttgtcagctcttctggttgctactgcccctacctgccaggctttggtaaactgcccctctccttgtcccttcaagctatgatgtggtgcgccaatggctgagtcttcctttttgactcctgaattttgctcatatctgtgttagtgactcctttgctacattttctttaggccaaccactttttttcttgaagaacgctggacaacccactatttttcccatactcatgttgcccacttcaaaactgctcttcatcctctagagagtggtcttttaaagggtaaatttgaccatcacttttctgattaaaactctccaaggggatcttgttgatcttaatattgacagaaatagctctaatgtggcccacagcctgtatgagctgactcctgtctgcttctccattgtcatctcttgtcacagtcactgggttccagccatgttgctcttttattgttccttgaaattgccatgggacctccagttttgaaggtcttctttaattcttctgttttcagaaattctctgctcctttcttgcctcctcccatccctagcctgcaattttataggaagtgttacattcctttttaaaaatttttattttaaattcagtggtagatgtgcaggatgtgcaggtttgttccataggtaaatgtgtgtcaggggggtttgttgtacagattatttcatcacacaggtattaagcctagtgtccattagttgtttttcctgatcctctccctcctccctccctctgtcctctgataggccctgttgtgtgttgttctcctctatgtgtccatgtgttctcatcatttagctcccacttacaagtgagaacatgtggtatttggttttctgttcctttaatttgctaaggatgatggcctccagctccatctatgtccctgcaaagaacatgatctcattcctttttttatggctgcacagtaggaaatgttacattcttagagaaaatcttcctcttcatgacactttatgacatttctgccacaggagtttgattctatagttaatatgttctcataacaccttatatctttgctccaaagcatttatgatggagtataattacatagaattgtttcattgatataaaataagttccagtgtgtgtggaaggatgttctgtgccttgtttttcattttatctgtaacaatttgcacaacttgtggcaaatgattatcattttataatagttattgggtaaataattaaaaagtatctctagctaaggccaaccaggacagcaaaaataaaactaaaatgaagagcacttgaatgagacagcaacagcagtgaaagtagccttccatgattattatcgaaatatctgttgggagttaagctgaaaactgacttgaggagtttgggaataaacatagcccacagtcagaggaaggggctcattcaaaaacatttagttgctctcaggtcaacgataggtctcaaattccatttttcacgagcatccacaataaaacctcagagcacaagccaataactcaagtactcaaatgccctccagggttccttccaagttgctctgctgacctgagctcattacttttatataatgattgcagcagaagcatctatggaagtactgtctacaatgagatagtcaaaaaaatactaaggagataattacagtattaattcttaagttttgcagaattaattaaacataaaaaatattattttggaacatcaagtttggatatatggtgacaaaacaaaaccactgctggccagtgagaacttctagggaatctatattatacatttttacattatgtgaatttgcataagtaaattatccagaataatttactcatgtcaattaacagaaaaaaaaacatgacttaattaaaatctcattacaggaactctcttcaatcaataattttggaaagtgacagacaaagatggtccacagggggatacatgaggacaaacatagctttagataagactgtgtttgcaccctagactggaatgtctcttcctcaaacatgtattaagccattccatttactgagcacctcttatattctaagaactgtacttgtcatcgtggtgggggaagggaggcataaataagctgtgatacttgggacaggacaaccaaaacctagtttccttcaaataggacttgagtcactcatagaagtctttcctaaatattccggtcttcaagaatttctctgaagacttctaaaaagtactgcttatgtcacgtgtgaatcctttcttgatgatgatgatgatagagaagtatttattatgaaagaaagaaagagaaggagagagagaaagaattgacatgagccaattcccaaaataaatcttttatatatatatgtatatatctctccctatatatatctatgtataccatatatatatatttatatgttacagataaaatgaatacatatatatgtattcatatatatatttatatgttacagataaaatgaatacatatatatatatacctatacacacatatctcctattggttctgtttctcttgagaaccccgattgatacatagatagaagagtgtatgtaaaacggaagcaaatagatcttcatggaagatcagttgggtatgaaagcaaagagctatgaaaagtatatgatgcttatttgcttattgttacttgtacagattttgatatgtattattgtaatgattacttttatgtcaacatgactgaactaagggatgctcatatatcttgtgaaacactatttctgggtgtctgtgaggatgtttctggaagagactagcatatgaatgggtagacagcatcaagaagattgccctccccattgtgggtaggcgtcatctaatccactgaggggcgaaatagaacaaagaggctgaggaagggagaatttgctttccgtttgaaacatccatcttctcctgcctgtagacgtgggtgctcccagttctcaggtttttagactcggatcaaaatatatgccatcatttctctcaattctcaggccttcagactcagactgagttacaccaccagctttcctagttctccagcttgcagagagcagactgtgggactccttggcctcccataactgcacgagccaattcccataataaatctccatatatatatatatatatatatatatatatatatatatatacacacacacacacacacacagatacacaccatatatatctctctatatatatgtataccatatatatatgtatatatacacacatattctcttgagaacccagactgatatatagatagcagagtgtatgaaacgtatgcacagtctataaattatatagtaatcacctatctacccacttacctacccactacccaggtaaagaattagaatatggccagtgtcttagaaactttctgtatgtctgtcctcgattacattctgttttatcccaccctccagaagtactcaccatcctgtttttaggttaattacttcattgcttatacttatgatattatcaacagtgtaaatgttttcaaataatatgtggattagttttgaaatttgaatagctgtgtaagaaaagagcaatattgccactattacacaatgcctcccaagagaagagaaatagaagtctgagaaatctcatggtcccaacttcatggaaagtttacatggatgagtctcctctaggcatgtcagaggccccactcagaccacgtggtggggttaaggtgtgtaccatgtactggatatccagcagggatatgatcaggggtattctctgcttctggactcatcgttccctacctacagctctcagagtgggtcaaagctgaacatttctgtgaagcaaattgagtgtcttcagctgattcaggaagcatggcagagtggacaggatatttattagcacattgacaagacaaagtcagaccagctactattgagaatcatgcttaccaaggaattttattctctggtaaaaagttggtatgaggtgtatgtatcatggcattgggcatcttagcgtgtataactttcagtgcatctgactcttggggtgcattggtccaaactctgggttgcccttgaatggggggaactctgtccttctgatataacattttatggtgctccatagattctcacatcctttctcctatgttgaatgacctgcttcctatgtcttgttctttgttggcttattattaagtattattattattactattatcgtagagctcatatttgagtcacttcttaagaaaggaaaaggagtgaacaatgagaacacatggacacagggaggggaacaacacacactggggcctgttgggtggtggggtaggcagagagagagcattaggaaaaatagctagtgcctggtgggcttaatacctaggtgatgggttaataggtgcagcaaaccactatggcacacgtttacctgtgcaacaaacctgcacatcctgcccatgtactcctgaactaaaaataaaaattaaaaaaaaagaaatgataagagggaagtgaatttttgaatcttgaatgtttgaaaatatctttattgaaatatcatattaattgctagtttgcccgggtttagacttttagatcagaaataattttccttcaaaatttcaaaggcatttttcaatgtttcctttcagggttattgttgagaaacctgatgccatcccaatcctcaattccttatcccctcatttgaagcttatagaattgtgatttcactgtgctggaagctcactaggtcctttacatctaaaaactcttgtcattcacttctaggaacttcttttgaaatattacagtggtaattttctcctttctcactgctgtgatatctctttctagaacatctgttatttggatatgggatgttctacatactttgttctactttacagtatattctcttaactttatcttacaactcttcaattgatattttcattttatttcctgcttattatttgaatttctaagaactcattcaaaatgatgggaatatttttcttatgtgttattctctttttgtttcatgtctgcattaccctatccctctgagactatgaatcatagctttatgttcctttttttggtcttcttttggcatggtctctattttctcctagttcctctttgttctgtttgtcctttgggtctctgtattctattttagagtggcttctttatcttagaggctttcctttaactctgatatccagtaaacctaggtacctgttcatgattaagaatgaactactcagaggtttatttgaagctctcattgtctggtatgttgtcaactttcagattcgcaagaggagaatgctccagtgtctttggtaatttttccttgtgctgctcagatttcccagaaaaccctcccactcttcctcctgtaacagcagaaatctgactgccagagcaactgtcttggagattaaacagtcagcattatttttacatagttacttatttcctttgttttcagtatggtgcccacaccctcaactgtgcttgatgtccctagaaaccttctgttttgctttttactttttttttttaagggaatacgtatcaacaattttatggtgcagcaaacatcttttagagtcatggagttgaagagaatggcaactagtggtctacctgattcttagatggcttcacccaaatatctgttactttgacctcttccttccctttatctgcctctcctggttccaaacatgactgggatgcccccttctggggccccttgaggatttgaggattctgtggtgtaacttgtgttggttttcaattttctttgatactgacttgtaatttaactttctcggctctatcaagttacttcttatccacttgcttttggcttctaaaatttggctgctgttgtcttcttttctttcttcccatttgcaagagtttgtttctacaaaaaaaaacattgtttataatgaatttagtgggtttcatggggaaacaaaattaatgtatgtgtttaacctgtcatcttaaccagtaactcggctggtgtagttttaatgttaagctttcacctatttaacacatatttcttgatctctgtggagtgaagaagaacatcatctcgcctccataaattctaagacaattacttttggcatcatttagataccctttccttattaagtttaggatagtcaagctttcaagcactaaaagtgctgggtaataatggtaattagccaaattgggaaaataaggccatctctctacctcgtaatttccttttttccctctaggtttagcagtacaatttgaattaagacaaattcagatgttctctaaacatattaatcccattgcacccccaaattatacactttttcttcttctaatgttaaaatagttactaaaccagcgaatgttccttaaccacacttatgctacgagccccttatccaaacattctctcagtttggatgatttcacctcctgaatatctcctgcattttttccttttgtattttccctgctgcaaatctctcaaacctacctctttgattgctgtcagacagtttttttttctgaattacaaatatgaccatgtcactttcttttttaactcccaaatgaatctgtattgctttaataaagtctaaacttagagcagcatcaaaagctgtcaaagatgccctaactgccctcgtattttcaacctcatttttcaccatggctttcctgggtgcagcacttcagtaagaacacatgcaggtgtgtgtatccatggcagactccaggcaatttcatactgctgtgcccttacacatgctgctctctctgcttggagcatcctccttgtgctgtctcctctggtgacatccttcaaaaccaggttggatgcctctaggaatctctcaccagccctcttgaggttgggctcagagccccttctttacccatggagagtcctctgcattggtgcatcctgcatcgacatggtttgcctgagcttccatgccctcttggagccccatgattttattcctcatgtcttgcatgctgcctgacagtgtagaatgtttcctactgtgagaatattgaatctgagggctgccaacagatgaatcttttcccttagaggaatgttttacccatttccataattatttcagccatttagatttaaaattcactcactggcctaggattaaggtaactttagtgtattccttttttttctttccttctttctttctttttctttttctttttttttttttttgagacgtagtctcgctctgtcaccccggctggagtgcagtggtgccatctcagctcactgcaacctctgtctcccgggttcacaccattctcctgcctcagcctcctgagtagctgggactacaggcgcccgctaccatgcccagctaattttttgtatttttagtagagacaggttttcaccgtgttagccaggatggtctcgatctcctgaccttgtgatccacctgtctcggcctcttaaagggctgggattacaggtgtgagccaccatgcttggccaactttggtctgttcttcatgagctgtttaatttctctgggcctcagctatgtcattttaatcattatttgtttagattcatataatttaactctagcattgtcatctttctcaaaatccttctgtcttttcctgatacttgtccctccagccccatacatccttttctggtgtttcctacataaagtttgctgctagcaagctctcaataagttcacccaagttttagctaataatttcaaatacactcccaaatggatttgcattactagaaagagttctggatgcttgaaaagtcttataactccaaagattaaagcttcctatggatgggagatttcatagtgctcattaaggatattgggtgaaggggctctactctggatcttctcctcccaccacctaaataactgtaccacatgcctttaggagggtgtgtgtgtgtgttacagaacatggtctccaattcttttgcttttatttccagccaatgagctcagggatgtgagttggatagaaacagtcggctagactaccgtgagatctgaaggataggtgtttattttagtacgtttattcagagaatagcaggcacctaggaaggaaaaccgattacagagataaaaagcagttaggatctctcggaaggataggaattcatgtgcattcagaaagaaaaaaaaacagttgttcttgtgtgtgtaaggaaaatcatctctgtggaaataggttgtttacgttttcaagtcggcaaattcccttcacagccacaccacgtatcaaatagagaagggagacttttttttttggtccctggtgtgcacaaggaggatcccttgagatgcatcctcgtggagcaggaaagatcataatagcaataatgacaacaatgcatcaattgttctcaaaggcatctatggggcagagtatgcttttcaaaggacattcacttctattccatcccatttgatcattatgacaaccgcaggagggagataagatgggtttcattatcaccatttcacaagtaagcatcctgagatggggacaatgtagagttatttttctggaatcacagagctagctagtggcagctttggagccagagcccagttttttctaagaatttctgtcacataaatggattatgtgtactgcatgaacacagaaatgcccaggatgtggagaaagcccaaacctctctcttacttggaagtctggatcagtggttctgggaattcgcagatttgcctggcagttctcttaagaggacacagaaaggccaactgggaaatcccttaacactagttcattgataccttgactatcttagccaggagaattggtgtttttattttccctggctagctgttgggtttgtaaatctccagagataaattaaggatttgttcagtggccttgaatgaatcatgaattgtttcataattgtttctttatgcaaagaagagcagaagggagtattagtggcctggttctttggacggtgtgtctactgacctggtatccaagggatgtgtttgctctgcttgatgaacagagaagaaagaagaggaaaggaaagcaatgctcagctcttccatgtaacacagactactctgcatttgttatcccatcagctcagaatgttaggtggcaagggttttggagatctagtgcaaacccctcactcagagaagggaattgagactcacagagctgaagtgtccacctaaagtccagggaaccagttaacaacaaagctgagactggaataaaaaagccaataggactagtttctagctaccattttcttagaatctcctttgtgcttgctacagtgatgcacacttgtgtatctgttgctctattgtttcttacattccccaaaattgagtcctattattccagtgttttagtgagggtaagttaggctagtttgaggtaacaaagtagcactgcaatctcagaatcattaatataacatagatttatttattgttcttgctactaatttagcgtagattagtgggtgacagatgcagcatgtatggaagtgcttcttcttgtcactgccaccaaaggacccagactgagagaatgtccaacttgcagtaggtgcacccgagagcacacatctctgggtttgctggggcaaaagaagagaattcccttctctgtcgttaggcccataagagcttcacatcgctttttctcatagccccttgatcagattagtcacacatacccatccaactgccaaagagctgagaagtcactgtcttcctgtccttcaaaggagatgaggacagacactgaggaacctgagagatgacagccactttgatcttcttgcttctactcataacctttaattgccacatagcagacaaagtgatgtttttaaaataaaaattgtattttatatatataaatatatttataattatgttatattacatgttttatttataactgtatattacatataaattatatttataattatacacataactattgatacaatatattaaaaatatattataaacacataattacatatatacaattatatataacttctaggaaaagtaaattcatatatatacatacacacacatatatatatacataaattcattattatttcacagctctgatggaagttccttccgactgtatttccttcctatcatcttaagataaaagacaagccactgtgccataaggcctctaggcctgtgtggcctggccttttctattctcatgcttcagtcccctaaacgtgtgctgtagcaggcatgctttcttccagttcttgcatattccaagtgctttctttgctcaggttcttgacccctgctttctttttgcttggctaattcttatgcagctttcacgtttcagcttcagtgtcatctctgacctgctctacgttccatgcacgtagagagcatgggtattttgttctccattatagattcagcacatcatactgcacctggcacaaagaatatactcaataaatatttgtttatattaattaacaaattaataaatatttgttaaatgattacacgcaagaatgaatgatcagaggcctcccatatacagcactatatgtagtcttctaaagcacattgacatagccataacagataaatcagtcacttagaacagcaaccatttatattcttttatattcttagcaatattattatgataaagatgcccacattgcaggtaatgataattccaagtgttcgcaattcatcacctgcctactggacattttcagcatacaacatattattatttttagtattaaagtacataataggaatggaaatctaaggtttgagtaacaggaaatgtgcaacatattttcaaagacagataccaccaattcagcctctctcatgagaccaatggagtgatattttccaaataaggtatcaaatgcaaagtgacaaaggatttttgcatcatttccaaatgtggaccagtacttaagaagagtagttttaactccctacattgacatagctaaggcaatttgatggttcggaaggacaatggcatggaatatgtataattagaactgtcatggagaatctgagacagattgttgtcatctagtcagatctcaacagaagaaaagtgattggaagcctgatatacctattttaaaaggtacaatgagtggtataattaaaaaggttgggtataagcttgacgaagttagcagatactcattaaaaccatttcagtaattcctataataatactggccatggttttaaagtcacctagtgaaagtcattatattgaaataattaaagaaaaacttcatattgtgtttccttggcaatagaacattcagatggagccacactaaatatttttctatttattgcagccatctccttaatgacacttttcagcacatattatacattaaaattgtttatgatattttgttattgctgaatttgatttaattacatcagggcttaaggaaaaggagtctaaactgagagagttcatgaagacttcgttttctaacagtttagcgaaaggtctttcaattcccttgcctctgcttatacgcctcctgctccccactcctaaaaccatacataaaatggtattgtccaatctcttcttagtcttaccttcactaaaggctgtgaactgccttcagaaatatactcgtaaaacttacacagactctcattaggaagctgctaccctccactcccgtcacagcttaactccaatctctttggtcttttaaataccttgtttcctctccatctttaagagacaaatagatatatctttcaagaatgtttcaaatgagaactcataactttcttgagggaattctcttgcccacttggaaaatagcttctctggcaggggttgtgatttccgatgggggcgaagtcacggcttttcgcaactactctgtatttttgttttaaatgtacaggaatctcttctaaagttcagatatagacttatactcccctgacatactcggggggtctggatattttcggaggttgaagcattcatattccatccagtggtttgtatgaaagtagagtcagcgtgatcaacactggacactgggaggtgactcttggacagccaaacctctcctttctgtgccagcttcccccttaggaagaccctactataccattgtcaggaattccggaattccatactcccttcctcaaaacccccctttttcctgaaatccactctcaggaaaacaggtaagctcctttcaatatacaaatgaatcatcagatcttatactctagctttcctgcagatatttgagtaattgcagaaggctaagctttaagttaaagaagttaatctttgtcatttataatagaaaaaaaataaaagcaaatgactaacagggaagaaattaagtaagttattacttatacctgatggcatgttaccaaagcacattgacagaaagtttaaatttttttcctataaaattattaaacatttaaaacttgtagaatattaatggcaaaacatgcttatgccatatgttgagcaaacacaggaggaaagagtataatacgataaaaactatttaaaatgtcacagaaaaagactagaagtgaatagttgcttttgagtaatgggattatggtttttattttaatttaaaacatccctttattattttttgtaacagggaaaaatgtaagtgtaaaataaagaatggattctcaatgggagattttttttaaaaaaccagtttctgcttgaatatatatacatacagttttttttctttctttctttccttttttttttttttttgagatggagtctcactctgtctccaaggctggagtgcagtggcgcgatcttggctcactgcaacctccacttcccgggttccagtgattcttctaccttaacctcctgagtagctggtatgacaggcatgtgtcaccatgcctggctaatttttgtatttacagtagagatggggtttcaccatgttggccaggctggtctcgaactcctgacctcagttgatccacaagtcccagtctcccaaagtgctgggattacaggcatgagccaccgtgcctggccgaatatctttatctactaacacctacactccttatttggtggggaatggcataccagttctccccacatgctttccagaaggctgattgagtggaacacttggagctgatgacttggatttacataagtctcatcttactaacacatcaaggcttttggatttaaacctcttcagcatcctctgtatccctaaggaatgcagtttctgcccctcttatccctgagtatagaggagaataaagctttggcatcaaatcgccttcagttgtggttgaatccaccatttgctagccgtgtgaccctgggtgtctacttaggcaaggaagacaagctttcttatctgtaaggtggtaatctggtgaaataaaaatgagaaaatctatgttaaaaaattcttagcacagattctcaaacacgaatagttacttaatatctcatgactcattattgcactatgcctccaaaactgaatgtgcctcatagtgtgggttttatcaagattgggatctgcctctcatttcttaggatgagatctttcttaggaatacctgtggctctatttcctccttccccaatcatgcctgaaaccttggattggcaaagtcctgcttcattcaaataagccctgggtttgctcaagagaacagtggcttatcttttccaagttaatagaatacaatttaaattacgttttcaccacaaagactgagttaatcctgctagaggctttttccatttcctgaccaatacgatttggcactggaggagactatggtatgttaataacagtattaattgttaaaattcacttgttacaaagttttcattgtcttggtatcattataattttccttttataaggagaatcgacttaaatcacttggctgctctttgttcttcctgtttgctaagcactggcgacgtcttgttttcagcacttaactgagtgcacatctcagctctcacctaaagcctttgccaaggggctaatttccaacattgacagcatcctccactcctgcgtccctgaagcaaagctaaagaaaaagtaggaaatagcaagagggaagaagtaatttccttcacttctttctgagtctgttcattccttcttggaattcagttgagggttaactgtcttctcctttcctgcgaatgcttcacgccgcctcctggtgaccaaataaagccatactttttttgctgtctttggaaatattcttcatggctcctgtgggctgtgggagcaggaagccaacaaaagataaggtctcaaatctcttcaaacagtcctcacacttgctctgctgccaagtcattaagcaagcaaactcctctcccatacgggctgttaacttttatttgtgtagtgctgcttttaaacatggctggcctgaactcttttttttttttctccttgtattgagaagaaactgcccagcatctgctttgatcactgcaatgtctgctagtctactagacttttggcctatctcagatgactctttgaatgtagcttgttttttttgttgttggtggtggtggtggttgtttttgtttgtttgtttagcctcattcatgtattcattcattcaggattcatttttctaattcaacaaatttattttaatcagctagtatttgaccattctagatgttaggtatatatcagggaatatagcagttaaaaaaaaaaaagaaaaaatccttgcccttctaaagctcactgtccagtaggggaagggagctatgcaagttactgcatatagtgtgccataatgtggttaagtgctttggggaaaaagtagaacagggtaaagaagatcagaagaatcaatgggagaggtctatcattttaaatgaagtggtcaggatgggttccattgagaagtgaatgtgagtcaagactcaaggaactgcaggcatgagccaaaaagccccacgaggcaagaacgcttcagatcctgtgggaggaaaccaagacatagaagcttttgttcatattcttggcagtatgagtcattgggggaacacagactaataaagtatgtttcttgccttcaaagagtttatagtctaatataagaaacaggtccaaaataggcaatttcagtagactgtgattgataaaacacttggctaaggatgctttaggggcataaaatggtctgaagaaggtgatattgttaatggcttctctttgtcagcatttgttaaatggccttttgtagagtatagaccactaattacagaaaataagagtcattggggggactcaaatttgtttagcaaggtctatataagttaaatgatataataatatattaaaatttatacattaagcgtaataattaagtgctcaatttattgattatatttatataagctactacatagcaatatattattaatttatatttagattgtctcaataggattaattcatagattgattattttaatgtatggattatgtaaatgtagttcattatgtttatgtcaatatattaaatttttttttttgaggcagagtcttgctctgtcaccacactgcagtgcagtggcgagatcttggctcactgcaacctccgccttctgggttcaagagattctcctgcctcagcctcccaagtagctgggattacaggcgcccgccaccatgcccagctaatttttgtatatttagtagagacggggtttcatcatgttggccaggatggtctggatctcttgacctcgtgatccgcccacttcagccttccaaattgctgagattacaggtgtgagccactatgccaggctctcaatatattaaaatatttgttaagtaatatgaaattaatgtattttgtaaattaaatcattaaataattgataatgagattttgtgtatttaattacattttatataagttaataaattttaaatattataattaatttcactttcattttaactacttttacagtggccactagaaaatttgaaattacacatgtggctgacactttatttctatttgtcagcactggtcttgattcactgaacagatggctggcttcctagttccttacctcttagcattccagaatgaacaaggttaccccaggtcactgagggacactgttgaggagaaaaagttggattcattgagatcaacatacaatgtctttccaactgccttaccttcttcttagtaacctgatgagtacttctcatgcaggggatttagataaaactttcttagactttctgtgtgaactgttagcaggtacatgaatttatgtgattcttcattctttttgcaaaaaaacagtctaagttttacccactctataaagtctgttctctatttttcagccgcttgtggtgttcatttaccattcaacacaggttaagcactgctactgctgattattataataattattattttgcgatagttttggttttacctgcaagaaaactcagtctagttttggatttctttataccgcaacccatggagcaaatgttactcatgtaaaactctcaatgagtgtcttttatctttgctgctgccatttcattacctgggacatttgtgccttgaattgtgtatgaaattctactttaaaacagattcctggtttatatactcatattgatggtctctattttattccttggaagcagttctgtgttctgtttcctctgtccccacccacactatacagttctatcattccattcttgagagtcataattcagcattcccccctgtatcagtccattttttcattgatataaaaatacctgagactgagtaacttattaaaaaaaaagagttgtaattggctcacagttctgcagaccgtgcaggaagcatgatgctggcatctgcttctggggaggtctcagaaagcttccaatcatggcagaaggtgaagggggagcaggtacatgacttggtgttgaaagcaagagcaagtggggaggtaccacacagttttaaatgaccagatctcatgagaactcactcactattgctaggacagtaccaagagggatggtgccaaaccattcacgaaaaaatcatgatccaatcagcctctgaccaggccccacctccaacactggggataacatttcaatgtgagatttgggcagggatagatagccaaactatattactcatgcagccaaacaccctcgctggtcaatctccttacagtgggcctgaagctctgaaatgtttttctggtctgaagattttgaatcttcccttgacagaacagtcaagccatactactcaattttaaagtggctggtgacatccgtatctcctaaggcaaagtgttctagttaatgatttgccacttctgctaggtgtgcacacttaattgaggctctgtatgagtctgatgctgagattagaagtccaaaagtcaccagaaattattacctggcataacctcgttttcttaattacaaagaaaaattaaatatcttctttccttggctaacaaaatagagaatgtatgtgggccataggcctgggaaatttaagatgtgatctgtctgttggattttattcttattctgatccccagacttctcactaaggagagagaagtccatttattagctctggaaggcaacatgattctgtggtaaaagcatggattttagagtcagatacattttaaatcccagcttcattgcacacagctgtgtatcagccccgcatcatgtgtgtgcggtagcacaaggccccatcaaaacaggcagtgcccctgtggtttaatgccctgcagttgctgctttgagattcttcataattttactttcgaatttgtggttcataagtgaagcccaatgggacgctggagcaagccctgggtcgctggccttctcacctcctgctacttccacccctccagggaaccactttgctgctcctccactcctgcccagtcacggctgctgctgctgcccctgcagggtctggatgcaggcatgggaggcatcggggttggcacctgctcccagggagtgtgacattaaatagcaaacaaaagcacaccatgcaggtcaagagggagaccacagaagaaaagaaatagctttttttttttcctttttccataaagcagctgcattttgattttgtcctgggcatcacaaattttgtagctgaccctagctgtacaactctaggaatgttccttagccatttgattttctgtgtatccatcagagtaatggttcaagcagaaaagcaccctaagatatgcctgtgtgtatgtgtttataaatatataaatatttgtgtggatgtgtacttatgcatatatgtgagtccagtgcatacataggtgacataagacttcagagattgtttaactgcttacaacaatagtagtatacctttaccagcacagggcagaatggctgtaagaacttcaaggttgctgaacctgtcactgtggaagagtgtagaaatggaccactgggcagatattccctctttaggggagcacagctactgccacactttgacccagcaggggtgggctggtgattgcattcaccgacttttctcctctgattctctcacctcatgctggtgccttcttctgatagaaaaaggaccagcagccccactgcagggaccacagttgacgtggtccctggaggccagccttccagggatggagtggggtgaggaggttggctagtagatctgtagggcaaataaagaatgcccagctcacctttagcagggttgctttgaagattacataagatgaaataagtaaaaccctttataactggaaagacagaggcatctattattaccgttaagatgattcatctctatggagaaactggagcaagtttgagttcaggtagtgggattggaagagtaaagaaagttctgcggcattcctgattccgtcatagcaccatgctcagaaatggtgatgtcatgttaaggtacaaaataaaattccagtgacacagcctcaaaattagtaacacagagatgggggtgttgcgacatctgggttctcattctggctctgacacctttctgcagaacaatcacacaagtcacttgcctcctctcctcccctccttactcgtctttgagaagggcgggctagttacaggctgcttgtgaggattggagagatatctagaaactgctctgatacaagccacagcttttatgagcgagtcttttcctgggccaagcatggaaatctaggttggtgggtctctgaagcagttggttgtccctaaacagcgacttcatttccggagctactttttaagtgttggtgaaaacacaaataactggagactgtgaagtcttttagcgccgggacctgtggggcagtaacctccaacaggtagagtgaaatgacatcctttctctccacgcctgagtgttcctatggcaccagttgcttgtaatgggtgaagaaaaaattgaactcgtttctcctgagacacacatacgaaagctgactctaagaaagaaaaactgaaatgtggaccatcttatttagttccagttaaagagagatgtgtttaaagcactctgatgtgtggccttaaaaaaggatggggctgcctcttaaggcggaatcacacgagcacatagaaataaaaatcaaagcagttatcatatttaattttcttactgactagattcattttgcattagcaggggatggcgaaggagagggactgggaatgcattatgttcttatttgggtcatttccttgtgctttggggaactttctcttgtcagcgtgcacatgcatgccgggggtgggcgtgagctggccccatgcactcactggcttctttctcggtgtcgtatgacccaggagggagtctgcagcatggggtgattctccacatagagagtcattcaccactctcaaccccgtctccaggtacttcctgtgttcatttgagaagaggcagctgacttaaagcctcatttctaagcagactattagaaaacatgtccgcataacctggagcggcagctcacgcctatagtcccagcattttgggatgccaaggtgggcagatcacgtggtcaggagttcaagaccagcctggccaacattgggaaaccctgtctctactaaaaatacaaaaattatctgggcatagtggtgcacacctgtagtcccagctactcaggaggcaagggcaggagaatcacttgaacccaggaggcggaggttgcagtgagctgagattgtgccactgcactccagcctgggcgacagagtgagactgtgtgtcaacaaaaaaaaaaaaaaaaaaaaaagagagagagaaataaataaaaaagaaaacatgtgggtacaaacaggaagagagagggcgagaggggcatcctggttggagacagctggactcacacatgcactttgtagccactcaccataaaggcagccccaaaggctctgagagctggagggggtgtaagagatcctatcctggaaagctcccatttcatacacaggcagacagcctgtgaggtgaatggggtgacgtggggctggaagagaagggcaagggtcaaaggaaagcattttacctcctttagaaaccatcatgcccccaaacctaaaacttagggaccaccgctgccttcatccatttgtcacctaattctctaatattccagtcttagtatcttttgagcccattttattcttgccctgtctattgccactgccttagcttctggcctccctcatttttcatttaaatgactgcaagtcttcaccctcagctttctaaaatgcaggtccggagactttactgttcttgctatatttcctcaacattcccacaccattctcaagacaaatcccaagggtgtgagcataggacaaagggccctctccatgatttaactggcttttaagactccagttgcaccacattacatatttgccaggcacagttctaagttctttacaaatgttagatcatttactcctcaaataaccttgggtgatgtgtatttttattgtctctacagaggagaaaactgagacacagagaggttcagtgattttccaaaggtcacacagccagtaaggagcagggctgggacttcgaccagacatctgctggcagagtcggtgcttttagccctggcacctgctggtgtggagtgctctgtatgaatcagacccttcctcacctctggcactgtacacaggctgtttcctcactttgaagcaacctttgctcctttctttgcctgagcatattctgtttgtttttccagattcacctcaagtaccacacagtgtctttcataaaacaagaccctgtcttacttggtttctgtgacacattataccagattgaaattactgattaatttgtctgtgtttccccagacaacctgtgtgtctctcaaggttagggacagtttctacctttctctcacttgcaactgaatcatgggggcacggaatgaaggatggtgcaaatggtctttcaattcttgtctctgactgttcagatcagacgagttacttatctctgagatgctttttataatagaggtaaacagagttcttcctacagcacagctattgtgaaaagcaagttaaatgatgactataaacccatagccctggtctggcacataatagatacaccacaaagccccctctgttgagtcagtctggtgtccttgcaatccatcctccactacactcatttttttctaagctcatttctccatctggactcatgcttgctatcaaggatgatctccccacttctaccatcacaattataaaaattcaaatccacctgtccactaagccttccttaactgtgtagctcgctttggtctctccctgtttcctaaaacatattctcagtgtcaacattctctggaatggtccccatcatgcccgctgcccccctgcctgaaaattttgactgtggatttatgtctcttatattctcaatgaggttgtatcctctcaagtgatcaaggctataatttttatttctttaccatatttacaactctaggagaatgacacgtgttctccaaatagtaaatacttgcagagctaaagtgaattgaagtgaattcctttcccaggtactttgctgcctcctagtgttgtggtgaggctccaggctgagagaagtttcctctgagctccagctcagccagcacccttctgagtgatgaacactgttgcagaccatagacctgagacagctggctgcggtttgacacagtttagaagatgctactacatcagaggcctctcttgtccattgggtcccttgtagtggacccctttgctttactcctgaactgagtatcagtagggcatctgtgcagggcttttaaagacttctttcctctctcaaatacctcccttcttcccagtttctgacctggttactgtttggagtttttaattccctctgatcttaaggttatattgcagttcatgttaacattcaaatactattgagaaaaataaaacataaattttccagttatctagattgtaaatgaatttatgatcctgacgagaaaaaggcatgaaaggtacccactctatgaaaaagtaaaatggggccacgttaatgagacagaaagcacaagaagcagaaagccttgtgtatgtcatagattaaccagaagttgtttcggctaggtaccggcagagacaacatggtacagtggaaggaacatggattttggtgtaaacactgaattcaaatcccagctttttcagctgttagctctgtggtgtgttaagtctctcagatcctcagttttgttgccagtgcagtagggcagcgatgcgtagctcagagtgtgtcatgaggattggatgagacaatatatgccaaggcaattaatacgatgctaaggggtttgtgtttttgaaatgcaaagagtttagttttgtattgattcccattacaagtttgctcctgtattttccggctgtctagtccattcacacatcttcatctcttagggaaaagacatggtgtctttaatgttctctgaattagcacagtgcctggcacttagggttgtagtaacaattatggaataaacgtaatgcctacagctaaagatgctgaaactctgtgactttccattatacattcttttttctttctctttttcttttttttttagaccaagtcttactcttattgcccaggttgcagtgcagtggccccaacttggatcactgcaacctccgtctcccaggttcaagcaattctcatgcctcagcctcccgagtagctgggattacaagtgtccaccaacacacctggctaatttttttatttttagtagagatggggtttcaccatgttggccaggatggtctcgaactcctgacctcaggtgatccacccaccttcgcctcccaaagtgctggaattacaggcgtgagccactgcaccttgcccattatacattctttctattctcagtttttatctttaatattttagagtcggagactaatgactcccacatcagcaccccaattaaatagactttttcctgtttatcacctttcctttaatttcctcattcaaagcattattcagttgtcctctcctcttgctgcttaagcctctcaccagctctcagtcaatgctcccagatgcagctttcattgcatgtgatgttgtttaatttcacttgtcttatctataatcacatcaagccatttatttgttaataggctgtttggtggcttcacagttggaattgctgtacatcacatttcatttccacaaggacatcctttatgccggtctgccttatgtggcattcgtctcttcctcttgccaggctgggccagcttctcccgctgtaccttccacatcagctgttcattttccccctgctgctgtcactgataatttccaggttaaatcttataagtggaaattggatccacagctggagttgaaacgcagctccttggagttattaccacagtctgttcccgggtaggtgggaaagttgaagatgatagatttccagtgcctgggaataacaatgctgtccctctaaccacaactaaggtgagattactttcccctggggagagcgatatttttaccttttcactctgagtttacatcagggggattcaagagaggcgagtggtttttcagtagttttctgttattttatgagagatgagttaaagtgataatgtaggctggacagcaaataagttataagtgattgaccagccttttaggctgtcagctatctcaaatagaggctttctttatttttttttccacagtagaaacatttgatttatttgattcaaacagtagaagtatgagaggatcaaataaataggtttgttcaagaaaaaaaaatattttagtatttcatgctttcaaagcctatgccataacctttgaattattcagcaataattaattcaacaactatttactgagcagcttccactgtttcaggattggaaatatcagcgcaatagatcacacaagattccatctttttgaagctgggcttctagtggacaagactgataataacaagacaagatacataagatgatttccaatgtactaggaagaaaagaaaacaggaaaatgtgagaccatcttgggtgagatcatcaggaacaacttttcataggagagttgatgttagtgaatccataattgctaaaggagatttgagtaattaaaaggggtccgggttgatctatatctctatttcttttctctccatcccatgctttcctctctgacccaccccagcccctagtaaccatcctgaggtcagaaatatcaagataccttaaggggctttctccttaagatgtcaacaacatccactgaggactgaatagaagatgccagcgcttggctcaggtgcaggggatggcaagagctgagctctgggctgtgaggagttctggttctggtctggcctcatcactggggctgtgtcaccttgggcaggtcttgccccctttctgggccttagccttcattttcatttgtgaagtcagtgtgatcagatgatgtatgaaatttcagaatcgtatagaagataacctacctattaccttaaacagtccgcgtgggaggagaaggtagcaatagttgacatgaggttgtgagggatcaaaatgaggctctcagtgctaccctacacccctcaactttgtcacactgaatctgacctggaaggtacatgtagggacagtttcttatagagaacacactatctaataagtggagacatggcatgtcctcaaaacatctcccttattgcccattccgggctttaacatctgccccttccaattactttgactcttcaaaggttttcagtgcaccttaaatggtttgtacatcttctgcccccttggatacaacagcatgcacggacatttgcttttctgattaatccctttgctaccaccctcaactcaaagcattacaggtaggaaaatggactcaaagatatacaggttaataaagagaagaggggaagagccaggagcacaagcagtgtccacgggctgctggtcccagccagtgagtgagcaaacataatggacctgggcatcgaggttgggagaatgctgaaaaagaaatgccaaagtcaatttaagccatgttatcctatttcctgggattggtgctgggtactgaacagaggctctcagccaacccctacctcacccagagcacagtatagagtatagacactgtcttgtacacactcagaatacaatagtgatgtgtttctgtgtgcagccctggactgtgtgaagtggcttctcctggacatgtcaactctccttgcttgtggcaggacatcaaaattggttagactgaaagtgtctaatgagctactcccatatgccaagcaccattttcagcaacagggactcagcagtgaacaagactggcaagatctccaccttcaagggtcttatattgtagtggggaagacaggaaaaaataggcacataaagaaaagcaaatcaatacatttcagttgctgatgaagaatgtaatgtggataagaaataactgtatgggtatttgtgttgctttaccctgcatgattgggaaagtctctctgagggatagatatttgagttcattcattcaacagagataattaagtaccttctatgctgcaggcccttttctaggcagaaaggattcattaatgaataaaccaaacagccccatacacagggagccttctttcagcaagaagagacaaagaaaaaatatttaaagtgtaattttttataataggtataataaacttcatatttaatgatgtataactgatatataggaacagtaatcattcttattgctttattgagcaatgcacatcatatataagtgtagttgtaacccaaatactaagagggtggagccacttaaagatttggataaagcacgtcccaagaagaacatagtatcctcaaggcacaagtaacatcctatgtgatggaacacttgggccaggaaggcatggatgggaagataagaggttgaagagagagccaggagccagatcatcaagccttgatttcatccaagtttcaagggaaaagcctgggaaagttttaaggagatggcagaaggaattggagagatctgatttaaggtttagaagattctctctggcagttggtggagcatcaacttagggacaagaagggcagcagggagatgggtgagggagctgctacagaggtctagaagagagagggtggtgacttgaactagggctgtagcaggagaaacagtgatacatagatgatacatatatatatatatatatatatatatatatatataggcaaataatagatgatagatgagtaaatagataatagatagatagaaataggtagatagatagatgtagacctgacagcgtaactactgaattggttgtaggatgggaaggaaaaggagaaattaaggttttcccctaggtttggcctgaagagttgggtgaatgttggggccatttatagagagaaggaagactttgtgggtagtgaagagggaatttggaggacacaagtaaataaatagctcagtgtgagccttttacagtttgactttatacagtatgcaaatgaggatgtgaagtaaatagatatgagactacagttttgaggagtggggctggtatttggaaggcatcagtggtgaaatggcatttaagctagggggaggatgagagcaactaaagaaagtgtatacatagagaagaggtttgaagactgagttctgggacattttcagatttggaggtctaatagatgatggagtcccagcaaaggagggcaagaaagagtggattttgacagaggaagaaaactgagtgtagcatagtaaaattctagattcatgggaaatgttgctgaaaaggtaagatgacagagaattaaacattttccttgagaagggatacagttaccgattacctttaaagagtgtggtggaggaccaaaaccaactggagtggggtgaggagaaaaaatagaaattagggagtgtcaacagatagcaaagacagcttttttttttttttttttttaagaattttgcttagaagtagagaaaagtgctatttgttggatctctagttggagtcaagagttaaaataaattatagaacaatatgtaatcataaagaggtgagaaaagtgtggatgaatgctgtggcttcctttttctctctagtagtagtccctagttggtctgcaatgaacttttgcaagaacgagagtggggaagactcttcatgaggctgataggctgtagctctcatggtttgtctttaacccacaggtagtgagcaagccatttgctctcagggaaaatgtggctttcctgacagccccagatgatccatctgtctctgcagcctataggtggggcatattggaaacaaagcatttaataaaatgtaatagttgtgactcgggacatagaagaggcagattgaaagagaagtggagaccaacacgccatctttccacataaatggcttcagaaagctgcagactcagagtggatttgttcgtgcaatcctcacctctcctactagttaacaagtcggcaagccagcagtgagggtttggtttgtaccctcagttattaaccattagtatttgtgtcatgtgcttttgcctgggaaggtgtccagagattggagagtagtgttcagtcttcagtgggtagaaattgatcaactgtagaaagaaataagttatcatggatatgtacatcagctgtgtcttgtttctaatggctcggctcgcgactagctgaaacaatgaaaggaaaaagtgtgggtaattttcaagtaattgatgtatttggggctcatgtaggccacaatcatgatagtcacctaatttgatccttatctcagagccaaatcttctcacagagttgttgacatgggatgtattttgatcttgattttggagtcttgaattctttttccaaatgttcattcttctccctctgtatgtccctcagcactagattttatcatcaggcacagaacatctttctgagtaatctcttccatactccaggtggcgaattaaaaactatgtgaggatgactggaagtaaaacatttaggcagtacttgctgctctggagacattcaaagaacaataaacacttctaatgtagtatttactgacctccagaagtgatagctgatagtgaagacagagtgcccgggcgctccaggctattgctccatgttgagattggctgagaggtcttcggaagtcctcagattgaatggtagtttcactttaaaccaagcaaaaattgtcatcaaaattcatgactctctcctaccccagctttcctccaactaattgggctctctttctggtcttgaatgcatcgagtttttatttgtctcagtgcctttgcactttctgctctctctactacaaagcccttcccagggccctacacatagttggttagcacattctcgtctttctggcatcaacttaaataccgtccccataaggagatagtctttgaacaatcaatttaaagtaatccatccatgccttttattttctttatgacacttatctcaactttgttcattttgtgtctcttccatcaaacaaaaagctcctctaaagcagaaattttcatccttcctgctctatgctgagtgcccagcccaatggcagacacagctgacactcagtaaatatttgttaaacaaaatggcaagtgtgagtgctgtagagtattatatgtttaaatattaatttcaaagatttttaagacttttgttgacttcttcaacacattctcctcccatgctataagcatctgggggctcttttccacctcttccctctcccatcacaatgtctgacacataacagatactaaacaaatatttgtggtatccatgagtgattccaattaatttgtattgggtatttcaatatagtcataagtacatctccatgtccaagtatatctccatgcccaagtatatctccatgtccgagtacatccccatgtccaaatacatctccatgtcgacatacgtgtccatgtacaagtacattcaagtacatccccatgtcccacatacacctgaggataccgaagcttagtgtggtgggcagaataatgccccttcctcatagatgtctataccctagtccctgggacctgtgcacattgccttgtatggaaaagggattttgcagatgtgactcaggtaaggatcctgaaatggggggattatcctggattgtactgttaggtacaatataatcacaagagtccccgcatgagggaagcaggaaggtcagaacctgagaagaggcagaggtcagagtgatgcagttgctccctggaggacacaagtgaaagaatgtgaacaacccctagaagtcagaaaaggcaaagaaatgaattcccccttagagattccagaaggaatgaaatcttagtgacattttgattttagcccactgaaatccattttggacttctgaccttcagagctgtagataatacatttgtggcattttaagcactaattttgtggtaatttgtcacataagcaacaggaaactcatacacttagttcctcacattgaaccctacccactctagctctctcgccatccctgttccctattagctagattccccaattcacacacctggaatctccagagagggagttctagagtgtgggactctcccaccaatctgtgtggatcatgagtaggtagatcagagatccatggaaggccatcaagaccatcagtggttggagtaggtcatgaacgtgatagggccttgagggtgagtagttactcctctcccaatttggtaaagaataaacttcttccaggaaaatcacagatattgtcatagactgcaagaagaaaaaaagcaaaaaaaaaaaaaaaaaaaaacaaaggaaggaaagaagaaggaaaggacagagagaattatgactgtgttgtgtctttctctgatacacactcctggagcttctccaagcctgtacttgccttctatgccatatgcaaatgctgtagaatgatttctttcagtgctaactttatttaattctatcatcatggtttttactttaggaaattttggttccaatagtttaagaataacatggaactgaccttagaaattgtctaatccatattgtgactggcattatgaaaaagctattattggtgaaccatggactgccctgtgggagttgggaggagaaggagggcagaggggcagagtggaagaggagaagcattcacagatgaattcaaggtctttgcataaatgtgaggtttcttaccactataattttttttaaataaaattaaagaagcaagcaagcaaacaaaacaaagagaagatggttcctgaggacaggtgttttatctaagacatgttggatgcccaggatctccttattaggacttaggatattaggccacagaaaccaaagatttgtgagggagaagttggggaccagtgtcaggtagtcaggcctttgctggtaggaagatggggcttacataccctatagccacacaggcttggcactggtcctgggtgaggagagagtggggcccaggtataggccagccaggcttccccagatgatgcgtctgtactttccagtctcactctgctcccctcaccacctctccacacaagcctcagttctcagtcactaagcagcattgagaggcaattacagggtgcagaactctgcccgggctcctggaagaaaagaatatgtgccatactgtgctaatgcaggctcttctatcatgcctctaataaatgggttcaataaataaatgggttctataaatgggtccacaagcgtatgtttgattcactatacttcatgttgtcattttcgctggctccttggggagaagtctcatgcttcagggaaaggcacgattcaccagaagccccacctcaaacttcctttttgtttttgtttttaaaaatgaacttttgtgttctcacagctccatccagcagggaatcctaaggaagctctgaggagagccacagcaccccctttctcctgcctgggtgtctcctgtccctccacaccagctccgtccgctcctttagtttggaatatttccttaacagacctgtaggctctgcctccctactccctcctaagccctcatccgcaatccacatgtctgacctctccaaatagattactagttcagttggttgctggacatcttagctctcttgctatccatatgatattggacaaggagaaagacagggtttttctttgttttttgtttaaggagaaaagtgatataaatgcccctagtccttgtcaagttttatgttattatcctttcctcaaaatagagcacacatgcacacaccacatacacataccacatacatctgcacacatgtgcacataaacacccacacacgtacacaccacatacacatacacacacgacacaccacaaatacatgtgcacacatatacagaaagtttttgctgtagatatgtcattcctttagcaactattttacactttttggagtcttctctcactattagaaagagctttgcggtttacttttagagaaaaaatccacctcctcctttagcatctagtcatcagttgggagacagtttttttttttcccaattagaaggaaaaaaattccaagtctattttagaaaagaaataaatattctctttctcaaaatgcattttcagccaaaatatgccatctgggggatgttagaaatttcagtcagtttatctttataaactattgaagctgcacctgttataaatggcctctgacacaaaacattctagaaacttcgaaaacaacattgaacatgacttcttgactacagatttaaacttatttcatcatacgtgcttcacagacagtgagctataaggtgtttaattagggcacagcagtcatttaatttagcagttaaataacttcaactaagataacgggttaattttgaggagagtgataaactccactccctaggtcttgttttattggactatggggcttagcccttagcactggattggcttgggaatttatttactgatgaattcaaccaatattacaggtacttttttaaaggcagtcagctgaaagttggaggaaattctgtttcagattctaagaaaataaacaaatctgctcaccttccactctatgctaccttttctattttgagagaataaacctctaaatctttagacttttatgaagaacacttaccatcatttgaatgtctctcttcatttccagtctattctgaaagtatcttcctcccaccactaggctttagtaaatatttataacccaatcatctcaagtccattggactccatcactggtatgtttcaattatttaaagtcagaatagcatcttctgggcagctaatgacgtctcaatagatatacattatcgaaacatattgttatttacttaataaatcaagcctgttggggaaagtagatgcaattcaagtaccagaaatgaggaataatgatggcatagatcatttctgaatcactctagcccattttacagcctgtaaagtacactgaattccataaaagtgacaaatggtacaacattgtaataaatagctatagtttgtgcattgtgaattggagcttagattcatattgaaactctctgtcaaaaaagaagaagatgaattaagtattaaaatcatactctgtaaaaggaattatatattttccatttatcttgatttattatatgacatcatgtgcttaagtatatgtaacctttccaaattgagttgatttaatgtgaagggaaaaaatgttaaaaaagaaaatttggtgtatgtttagaattttctttattttcctgctatatttttataaaacttttaactgttccatggaagcttaatcatattacattttttaagttgaattcccagaaatatgcaataacatctacagggcttattaagaacaaatgtgctaaatcacaattaatatgactgtttttcattcaaatttcaacgtttgcatattaagaacacataaaactggctgggcgcagtggctcacgcctgtaatcccagtactttgggaggccaaggcgggcggatcataaggtcaagagatggagaccatcctggccaacatggtgaaaccccatctttactaaaaacacaaaaattagctggacatggtggccggcacctgtagtcctagctacttggaaggctgagacaagagaatcacttgaacctgggaggcagaggttgcagtgcactgagatggtgccactgcactccagcctggtgacagagcaagactccatctcaaaaaaaaaaaaaaaattccaaaactttcagtgaaatattagctgtatgaagagagtgactacgctgaagggtgaatctagacttccaaaatgacagaccgaggaatgggcatgccttgaatttttccaaatttcctggaatttaagtgatacatctaccgttctatttatcattgaaaaataattcttagaggaataagcacatgtaaacaatattctattgacatctgctatttactccctcaagttaacaatacagccacaaaatgattaagatgaacaaacccaactcttactgcattgcttcctaaggagatgaagtggtttttcttaggcatgtgcattggctccattttttttaaagttggtttgcagcacacttcaggaggccagaagctaaacaagcaagtgtgagcgttagcctgtaggaaagacaaaggcacaaagtgaggaaaagaaatgtgtcttggtcaccctcacctttcccggtgtccaactgacattacaccatctctctgtcctctgctcatctgcctcttgcatgttgcattcttgaagctttcctctgtcattttgctaatttctgggatggagctcgcagctcacccgctgggatagcaggagaatgggtgtgaagtatcaagggctgggttggccacaatgtcctccttcgccttccagcaatcgattcctttgtgctccattttttccaagtgtatcaaatggatccaacgctgtcctgtgcggagtaaaagaggtattctaatgatattctaatggtattcaaatgatattctaatgggaggtgtaattttatgaatacttcttgcatctcatctccacaattaaagcataaattttttggtttgaattctgtcaacagagactattcactaggccccttctctacacaaggctaagttgctatatatgtcctattttatataattatctaaccaagcagaaacgtaaatatatatcttcatttagcttatgaaggaaataatttccaagctcactaagaccatagcagaggagaaagactcaagaccatggttgtctgatggcaaagcacctactcttccccctatttcatattgattctcattaacaactaaggttatttagaaactatatattccatgatataaggtacccggcagatcacaggccttcataaaagttttaagttaataaatcaaccactgagggaaaaggttttttctctgaagtcctgggttttccactggtaccaaggtattaatagtatcttatacatagtagacataagggaaaggaaaatagaggagaaaaggaaaaaaaattggggagaaatgaggtagatgagtgaaggaagatgaatgaaaagaaagacaaaaggcaaagcagggaaggagaaagaatatctcaggaacgatttctgttccaaccattgataaactggtacaaggagtctactgctctcaggctgtggtgcactgtttgttttgtttttgaaattataatgaaagaagagagagatttaaagatcttcactcaccagaaaagttttgtctcctttcatccattaataattttatttaatttcaatcacttagagtggtgtggactaaggatgctcttattgccttcagggaacactgcagaggcctggaatgagttatataagcaatatacaagcaaatgtcaagtgtaagcctcctctaagctcagtggggcctcgtgatggaggttatagcaagaatggctgtgagcctctggttcaagaagggctaatcctggctgtgttcctgttctgccaagacaggaactctgtcactatctccttagccttagtggactagagcattagctcttgtattttcttttgcacaacagctgctgggcttctcttttaggcctcaaaatgcctggtatagtgcgtgacatgaaataagtcctcagcaaatacctattggattggattgattaagtgggaaagaatggagtaatggctttgtcttaccacattgcccacctgatctgttctttctttttgtcccaagcacttaaagcattcttattgagtcatggtgacaagctactctctggataaggcttcttgaaatggattttagtcaagcttagcaccaacggccattaggaagccaacaacacaacacatttctcctctgtacttcgcagattatttagtgaactcagccatgcttcccttggaggagtgaaaacagacatggaaactggggtgaggcacacagcgcagcatacttctgtcctggtgtggacctctgcatgaagaaatgtgatgtgctaaataaattcctatccccaggaggcttgtcttcttatctcagacctgccacctataaactacgtgacttcctggtgttataatttactcttcttgtgccacagattccttgtatttaaagtggatatttgctaagtgtctgctatgggtcaggtgcagtgctaggcacacatggacacttaactcatagaatagattcattcattcattcattcattcattcaatgtatattattaagtacctccctctgtgttccagacactattctggttactagaaatactgcaatgaacaaaacagataaaaataaaatatctttacccttatgggggtggatgtctataattcagacatatgagaaatggactctgtgttcagtagccatgaatactaaagagaaagagaaagcaggcgagggagacacaattttcaggggttcaggttcaattatcagaagcgttttttccttatctcttgtctttagatagcctgcttgggagacaattcactgagcaaaccatgccactgtcaggaagaacattctgggctcagggaccagcaagagcaaaggagctcagccatattaacgactgtgccaggatattttactacacagtgaaaaacactgtttaaaataatgaggcattatcacagaaaaagaaatgatcacatttaaaaaaataaatttgtatgtagaaataattttatatgtgcaagaaagttgcaaagagagtgcagagagttctcacatgctcctcgacatcttcttttcattagcattttgcgttatcatggtgtatttgtcaaaacggagaaaccaactaaattatgatcctgctggtttctccactaatgtcctttttctgttccaagatctaatccataatacaaaattatattcaggaaagtccattttaaacttaggtgttaagttttatttttaattctgattgaatgctatttccgtgtaccaggtagcagttgaaaggcagttggcaaatacttgttaggccaccaagtctcccttaagtgagtcacacacagcaggaagaacaccaggcaggtggtctagagtcctgggtcttcatcccagctcttcctcaaccaaacatgtgtccttggacaagttttcctctggagctgaggcagatttcttctgtacaaaatttagaaatttaggttagatttgtaagatccctccaacctcttaaattctgccctggcattatcatggcatcagtatcttcatactcagaagcatcaaaaattatgtgactgatttccctaatgccaaacgttggttcattacagcaccagagtgggctgagagagcttcagcacaacccttgcctctgactaccatactccactccaggctccctccttcctatctcccatcctccaacagctggctccagacagtaggtgttaacggctgagatcactaaatgaataggaactattcttagtattttacttgtatttcttataaacacccttatgaggcaggtacaatttttttggcttatctatcttggtagacagaataatagccccctaaagatgaccttgttgaaatcctctgaagctgtgagtatgctgtcttacaaatctcacatctgcaaagggattttgcagatgtgatcaaagtaaggatcttttttccttagttggagattagaatatggggagattatcctggggagatagggagttattctggtgggactgatataatcataagggttgttttaagagggaggcaagaagtcagagagcagaggagaggctacattgctgattttgaagatgaagcaaggggccataagccaaggaacgtatgaggcatctagaagctggaaaaggtaaggaaacagattctttcctagagtcaccagcctgtgacataataaaattacattttttaaagctactacatttgtagtagcatattggcatattggtttctacattagtagtaatttgttacaacctcaataagaaatcaatatgcccatgaaagttaaaagaatgtgtccagagctggaaggcattatcctcagcaaactaaggtggtaacagaaaaccaaacactgcatgttttccctcagaatgggcactgaacaatgagaactcacggacacaggaacgggaacaacacacactggggcctgtgggaggtcggggactggaggaagggagaacatcaggaaaaatagctaatgcatgctgggcttaatacttaagtgatgggttgatcggtgcagcaaaccactatgacagatgcttacctatgtaacaacctgtacatcctgcacatgtaccctggaacttaaaattaaaaaaaaagagagagagagatactgtaaaaaaaaaaaaaaaaaagtgtccaaaattgggtaactggtaagtggttcagtctagatttgagcataggccatactgcttcactaatgtaatgaaaaggccttccccatagttttttttcttttattgatacacactattttatatatttatgggggcacatgtgagtgttgcatgcatagaatgtatgatgatcaagtcagggtatttggggtatctaccactatgaatatttatcatttctatatgttggtataaagttctaacttctggttactttgaaataatcaaaatacgattgctgagtatagtcactcgtgaatggaactggaggtcattatgttaagtaaaataagccaggtctataggctttttgtgatgcttgaacgaagtacacagagaatgcaatgcttagaacacacaaatatcattgagttctgtagttaccacaacaatttgtggctctagtccacgatttctcaatcctgtcacactcacccacccatcccattatcgcctcaatcccgagcctctgtcctcggatctgacctgtttgacttttgtaagacgacaatcagaattacagtgtcaaaaatgacctcatgcaattgtacagcaacttatgctattcaccttgcataagtaaacgcgatcatatttagttttgagtcaaacatccttgggaatgagttaaagaatgattcgcctttgctgtaggtgtacctatccctctctcttgctctttctgttcatttgccttctgcattctacctattcttacatgtttgtctctgtatcaccaaatctattttggtcccttcacttcagcctatttcttgtttttgtagcagtccagaacaaagctacaatttattatttaatacataaatagaatttatgtgtttttaatataaagatcagaactgtaggaggttttatattttccttaaaactccaggcaaacaagatttttgactaaattgcttttttatatatgattctgctttttctcatcttatatgttaatagtcttgggtatgaaaagtacttaaatttagagacatggtaatttagagacagaggcctggtttagatatgctgactttttaacactgagaaagtctcttagagtccctgaagatgaaagtgtagattttagttactaattcacctcttgtgcttgttatccatatgaggagctggtaagggacaaatcctgcaagagtgagaaaaagcacccatttttctatttgctctacatttgggcttaaattgctgctaagtcattccccgagggaaatctggagtgagtgcatgttacaaataaacactcccaactttgctttccacagcctcagcattttcagctccataagagacgctctgaacaagcaaatgtgcttttaacttagctctaaaatatgtcctgataggtgggagctatttttaagacaacagcaaggacccggcagactgatatttgctggaacccaaattgcctcacatcttctctgactttgcccaacaatgaggcccatcaggttattattgtcccctgagaaaatatattttgcattgcactgtatgttactgctccccttaaagatgttggacatttttaagctgcgtaatgaggaagagaaagtgggtggcaggataaagaagtgggaaaatggtaaagagtcctgcatgagaaacaaagaaatctttgcaaagtgaaacaagagcaaaagagtaagataatttaaactagagtgataaatcacactcacacacacacacacgtgtgcacgcctatcaacctatcagccatctgttaatcaattatttattaattatctatgtagccatctatgtcaactgtcaatcaatgtatcatttatttatctgtcaatctatcatctaccatgtaggaggcaggagggagaatgctatatttgaactaaagcagaataaaatagtaaaactagtctctgtgtttcttttgtcaaagagggtgaatatgccatgaaagtctaatgggggatgagaagtttgtctccttctcttctttcctctcagcagcaccccctttcccacttcaagtcctcctcaaggccaggtgctatatattgaaaacagatttataaaaactattcaaaatattcctgagagaccaggtttgtcaccaaagacttcccaaatgataacaaatcattttgttatcatattctgaaaagcagaaaatgtggactggaagccaggaaacctggagtgtagtctgggtactatatctcactcaaagataaatgggaaagggcagttctccaacttcaatatcaccgtggggcccccaaatccaaccaacatatctagaagctgtctgactagatgttcgaatataactcaaaacaatccaacataagatcccttaggtaggagctttggcaatgtgtccacagtaggcagaatgatgggggaacttgaaattatgatatgaaaagtagatgaaggtggccgggcatggtggctcacgcctgtaatcccagcatgttgggaggccaaggcaggtggatcacgaggtcaggagatcgagaccatcctggctaatatggtgaaaccccgtctctactaaaaaaatacaaaaaaaaaaaattagccgggcgtggtggcgggcgcctgtagtcccagctactcagaaggctgaggcaggagaatgacatgaacccgggaggcggagcttgcagtgagcagagcttgcaccactgcactccagcctgggtgacagagtgagactctgtctcaaataaaaaaaaaaaaaaaaaaaaaaaagaaaagtagatgaaggaattagagatgtttatcctggaatagaaaaaattcatggatggactatataaactctgtgaaaggctgtcatgcacaggaggaatttgatttgtcctattctattgtaaactggtggttctgacacggcttccagggactcatctactggatcatagttagacccataagtaaaaatgactgctagctgtatactgcttaaataagaacagtttggggtgatacttgattttgtttggattcgtgcccccacccaaatctcatgttgaagtgtaatctccagtgctggagacggggcgtactgggaggtgatgggatcatggaggtggtgtctaatgggttagcaccatcctcctagtgctgttctcctgagagtgagtgaatgagtgagttatcgtgagatctggctgtttaaaagtgtggtgcctcctcactctctcttcctcctgctcctgccgtgtgaagtgctggcttcccttttgccttccaccatgattgtaagtttcctgaggccttcccagaagccaagcagatgctgtcatgcttcctggacagcctgtggaaccgtgagccaattaaacctctttttataaatcacccagtcttgcatatttctttatatcaatgagagaacagactaatacctttaacatacgtgtaatgccatcccctttctctcatgatatgccacttcatagagggcagacgccaccgctaaaacttatggagggaaccagaaagtggtagggtacgtctctacagaaaaatgtgctttctattgatgaaaattctgacaattaattgaattgctgtggtaggtagtaaactctgtcacttaaggtattcaagcagaggtttgaatgaactctctgtcactcaaggtattcaagcagaggttattaattaatataatacaatatttatactacatatattgtgtatatattctgtatatgtagtatataatatttatactacatatattgtgtatatattgtatatatatagtatataatacaatatttatactatatattgtgtacatattgtgtacatgtagtatataatatttatactacatatattgtgtatatattatgtatatgtagtatataatacaatatttataccacatatattgtgtatatgtagtacatatataatatatacagtatacatattgtattatattaatgaataaccactaccatccaaatctgtctctcacatacacaaacatgtatgcacaaggaagaaaataaacatcatgaaagggcagggatcctttctcattataaaaataacatcatcttttgtaaacaatttaactttcaaaagataatacagttggaagtaaccaaattgtgactctatagttaaatactttgaattgatctaataatatagaatgtaaggtgttacctagatgagtatgaaaacagaatgaagcaaactcaccaaaacatgaaataggccccccaaaataatacaacttgtttatgggaaagaaaacacattgtgaagtagacgaaaagatcgtatctatcattctataataatcaccaaaattaattcctcaaaatctcagagttggtagtggcatgaagataaataaatgcctattagaacatgaaaggttcagaaatatgagaaacatgatcagaagaggcagatctctccaccctattcaatctgtccagctcccgtgacatgtgctaaatgagaactattgtgtgagctttcagggaaaggagtaaacctacagcgaatgataaagtctccagatatttgaggttaatgaaggggaaggaggaggaaaaacaacatttgtggagaggctacatgtgccagccatcgtgataggcttttaaaatgtgatatttctcaaaactggtccatggggatgacactgttatctcttcttacagatgaagaaactgaagttgagtggtcatgctgagattcatatcacagcttttagaagcaaagcctgtgctctttctactctaccgttctcgagaatttaaagtcgtgtagaaaacacaggcgtggaacctataatatttaatggacaaacaagtgtattttactttttcatttagtctttgtttgtttgtttatttctgagacaaggtcttgctgtgttgtccgagactagagtgcaatggtgtgatcatagcccatcgcagacttcacctcctgggtctaatgatcctcccacctcagcctttcaagtagctaggactacaggcacatgccaccatgcccagctaatgtttccagtttttgtagagacagcatcttgcttatgttgtccaggctggtcttgaaatcctgaccacaagcaatattcccaccttggctttccaaaacattgtgactacaggcaagagccatcacacctggttatatttgtgtttcagaaattaagaaggtttgagaaaaaataaataaatgaaagatcttcatttggtcaagtccaaatgaagtcataacttacaggcatcttggagtgtgaacaaagagaaagcaccgatagttccacacaatcaaaaggggatttggaaagatgatcctgaaaaaaacacctgggcagggttctttataggtcactttgcagaacaagagaagtacaaggaaaagagaaagatatggtcccaagctatcaaacgacgaagcagaagataatccaaaagcaggtttctcagctcaggaaagcaagaacatgaacaatctcttcaaagggaaatagatcttgggccagctcacctagttcctgagttctagagagttttaagggctgctaggaaagctgtcttgatcttgttagggcactaccctggggagaaaacactcacatatggaagaaatgcaatagctaattcttgactaactgattgataggatgggaacaatgaagggaatgagggtgagaggcaactaatattaactaaaaagtaattgctgtcttttcatcaggagtctgctgcaaaggttgccttactgcaaacaaagtggctgaaaacagataatcctttgctaggacatctccacttttccaaaggatggaggcatcaaagaatgattactacatttgatcgtggtgaaagaggaatcatgactaataccaagagaggctcaagcagataaactgctgaaagaagtatggcattttattccaagtggatcagaaatatcctgttttatgcaatgatggggaagaaaatgaaagactcaggacatttctgggcaagggacagtggtgtcagtgagaaggggcagaccattttaccactttatattacccgcctcatgtgactagacccagtctgcaagcatcagcactgtgatccaataatctgttacaaaattcataggtttttccccctcccattcaaagttcccctgggaccccctatggaaagaaataggaagaggagagcaaaatctccctctctagcagggtcagcatccccgccctgcacagcgtcagcgccgcttgcccaccactctcctaaagacccgtcattatgaaaggaaaagagaagctaatggctgacttgatggaaacattcttggcactgtggacaggcctgcttggaggccctgtctgctgagccttgggaatgtgaagaggaaaggtagctggttaacattgtttaacacagaattaagtcataatcgcacctgaggcatattccagatctttgtccccccagcacctgtcacatttgatttaaagatttctcaaagtgaaaaatggtctccataagataaagacaactccccaatagcaaccgcaacacaaaactgctacttaccacgattttccagggaaacaaggaaaagggctagattatacagcaagcattatgtgagagaatgcaactctttttcttatacatttgaaaacattggagggaggcagtgaaagtttctccaagggctttactgggagaacatgaagtgctgggagacccaggatttccatgagtccattgggcagggcacagcgaggcaggctgcctatgtgggttatacctgctcttaagtaaggcaatggaaggtaacagaagccaagaaacaggatccataaactgaatagttctcactcctcaaagcccaactaaatagcaacagcagggagacgaaggggcttgaagaataaagatgaaaaatgcatgctccatttattagtatttgagttttcaaaagttgtatgaaaagatgggaagcaatgggacatttgatgacgctgaaaatggaaagtggggatttcatcggtaagagtgattggtgtgcaatttaggagagaaaaccgaagaagaaggaagcaaaagaaaaaaataaagacaggagacaaaagaatagctggcattagaggggaaggctgggctggcatgtcacaggatcatgttccctctatgttgagatgtgggtggctcagtctctggggattatattcataacctatatagaaaaataaggcaaagccaatcagaaagggcattaacctctggaagacgaggatgtggatgaactatatgctattattgtttggaagtaatgcatttgcacttcaactttaatgacagaggatgacaaaaattagaaaggtagtttctagtcttttccactatagtaaaggactgatttcttatagggaagtaatttctcctgacacattatattaggtaaagattgcatcttatatgaattaatacatttaaaaacaaagagaactattcacctttttttgatttgtttcagtttaaggggctaaaatctgttaatccgctactatgtgctgtctcctttggttattttatttgctcttaaccacaaatttggggtggtagtcttctgagattggtggaaaactcatgattttctcaaagtcatggtgttcatacaaacactcagaaatcaccctcattgggttcagggaaaggtaggcaatgtttcattccaagcctggccactggctgattatcatccccaccccctccacttattctgcctccagacaataaacttaaaggtgaaggcagggaaaggggaatgaagagttcaggaatatcagagatgcgtgatgaaataataacagatgaactggtgattatgatatcaaaagcaccactacaattgttcaggatgtaaaagaactaggataaagtaaaacttctttatcaacaaactgctggttacccccaatgtagagttataaaaaggaagagatggcagtgccaagatggtggtggtgggatatcaaagtcctaacagtaaataaatggcacattcagtgagcttaaattaagagagttatactgaatggactgtttacaaacatgtgggaagagttagaggataattaaacatccagggaccagtaatagtgagaaatccaatttttcaaggggcagagatattaaaaagtgattatcacatttgtttgtgtcactacctgtggtcttgaagagggaagaggagggaatcgtagtactggaatttaatgagagctattgcaccaggagaaaggtggctggaaaggagctacattcttagagggacacagtgaaaatctgtgcctggcaagaaggaagcctggggatggggtgaacaaatacccctatctctctgtctctctttgatccaaccttgtggttttcttacagggggacaagggactttgagtaaacagcccacagaaatcaccctctttgggtacaggacaaggtagggaagagtggagaaaaagtctggagtggcaagcaaacaaacaaacaaacaaaaactagcccacaggactgtgactgagctaattagcacaccactccttccaggccaccctacagaagccaacactaaacaaaaacacagcatctgctctgcaagacagactcaagatatgttctttggcatgtctttccaacaaaattactgcctctgggtcatcctgtgtagaaattctggagctaccaatgaattgggaagagtgttttttttttgtttgttttttgttttttcatagaaggatgagtaaagaaatttcacttgttttagacaagaggaaggcaagaagacatagttaatgggtacggcatggtaaaaggagtacagaaattaagaagagcaggcaaatagatgtgatggagaaaaatatatggtatgttatcaagaggaaagagacagagaacaacgaatcatgatttgggaataaagttggcaggactgcagaatggtgatatgtatgttttctccctcatctgtgcagcagctttcaacactgaattaggaaaaaatgtggatggtgatgtatattactttatttacacctcacagcaaccttgcgagataggttatccccatcttataaatagggaagttaagtaatttgtcaaagagcacacacttggtgatagggaaagccaggaaccaacctcgcttttgtttgtttgtttgtttgcgagttcccttggccaacaggccttcctgtagagaacattgggaggacatataaattgaaagcagagtggaggtggccagtatcacatacctgggacccaccggactcatgggcttccaataagagtaaccagaggggtccatagaaagtcagagctgctgccattgatgacgaggccggaggggctcttttttgccatactttcttaaagcaccatggccctatgctcttaaacatgtctctatttttttttaaagtaacaggcatgacagcaactgtattggtttactagagttgctgtaaaccacactctgggtggcttatacaacagaaatttgttctctcacggttctggaggctgcaagtttgagatcaaggtgttagccaggttggtttcttctgagggctgtgagaaggagcctgttccatgcctgttccctagctgctggtggtttgctggcaatctttggaagaagcatcaccctgatctcttgcctttattatcacgtgacattcttcctgtaagcctccctctgttcccaaatgtcccccttatgaggacactagtcatgttggattaagacctaacttaatgacctcattttaactaattgtattagtaacaactctaattccaggtgaaattacattctaagatactgcaggttgaacttcaaaatataaattttggggggatataattcaacctataatcgcaacctataaatttgtcaacaagttctaagataaattggcaaaaaacataatagatctacggtagataacacaaaggaaaaccatggacatttagaacactgctaagaactatgataaccagtatctgtacaaatgtaattggctctggtgttgaagaatcaattatacaaatgtatgtaatgcacaagtatattttatcataacctctgagaataaaatgaaataccatatgtgacagcactttacaagctgtgtggtattcaaattaaggcattagttttattgctattaccatgtctttatttatataggtagcttatttttattgttacattgggcatttcacatttttatggtccatttctttttatttcagttacatcctagattaatatcatctatgtctatttcttcttaggaaactgagtttctccattcctttttttccttgatcattagaaaacatctttcccaactcccatttaaatgcaaaatggagtcctggcactgggttgctcaaatagccaactccatctaaacttagctcacgacagaaggaacttaaactgtcagcaaaatcagcacactgactgcaaaccagttctcatagagatcaattataaattgagacggtgttctggatgctttagtcagatttggctggtaccccaatgatctctgactctatttcttcagatactagtatgaattttcatcttcaattataacctgctaccaggatggcatatacctgatcctcttctatttattatttattttgcagaaaataaaaataggaaaaaaaccctatgtttgtacttttacatttaactcaaaactcaaatattagtgaattcctttgatttatgtgaaaattaaagttggatctaacataggcatccagcctcctttttttgacctttcgtcatactctctttgctactctcaaatttggtcaccccacactggagactggtaatttgcaagttaattcattcatccagaatttattgagcacccatcatttatcttgtactcagctagcagctatagaggagataaggctagttgtaagtatgggatttggtgaatttaatgttattgttttgattaatgactgggcccactggtttccgatatgcagtactttgcaattttgaggggcactgacttgacatatgcgctgggctttgagtgggagccctttataagtgagggagtggagtgaactgctcagcgcccacagctcagtggcttgattgttttccacttgccacagccttggctctcctcaatttttaattttctgaattttatagggggaaataatgtactgtaatggtaatcatggaaagccttaaagtgtgtctccaaaaatactgaaactctcttctcctgtataaaataaaaaaggtttgcaatctagattcagagtttagaaataagtaccttgacattttcagcccctaagagaaccttttaccccctaaactttctgtagaatttataacctataaccaacaaaacaccaagttatttctcaagcagctatgcagaagctcttctatttggaaagggaattaacaaaatcagtataagacttgggagctttctgcaaggagtttataaatctcgtcggagagaagggacaggtttctttttatagcatcaacacaagtcaggaaagcaggaaatgataagccatgttatttgttccggagtctttaaacccagactctacatctaatcaccatcataaaaatgccttttttttacctccagctttatagagaggagcctcagagtgggccatcctggaggagtgcacctatcagttgagaaatagggatgacaaggatgtaggcagctgttgcattctaaaatgtgaatttgttttgtgaaagcctttcattaacaaaattatgtgccgagaaagggcaatgacaaaactgaccaaattccttcccttgtaggtcagataacatttaagagctttacatgtctaacaaacttgaggttgctcaaactggacaaaggaggagattaaaacactttctgtgatgacataaagcagtgctacgggtaaggcctcagtctcctgccagcagaagcaaatgtattttctccatttaaaagagttgccttcttaacccacacttccccaggcattcggtcctgatagggcttggtttgactgattaattgtaattctgctccatacaaggtagacagtgatgaattgatacattaaagatgtgattaatggttactttctattcagtgtaattatcaggtgatagtttcaatgaaaaatgctggaaaatgaaacttttcactctagataactatccaccctgtctggaaagaaaaatggttctctattttcaacattttactctagatcaaggccaagagagacagagagacacagcacactggctttgtgagttttatagaatgagacggatttggaataatgcctgtctttaaagaaattcttagagaggaaatctctggataataaaactttaaattttatcttaatcctggattactttgccagctcctgcctggtctttctggtcaattctggcatttaatctatcctgaagatggttttggattaatttccctaaagcaccgcattaatcatatcacatctgttttttttttttttttcggagacctccaacaacttcccacttaaattataggaagaacaaaacatcaacatgaccctcaagaccctttgataaaaggcaaacactctttgtcaaactgtttcaattcctgtgcgctgttctttcgaggctgtcagctcactgccatctcagctggccatgatcccccgaggccatgctttgctttgcctctttttctacatgtttttagctggtagaaaaaattgtggacgacttaaaaagggaccaaaagattaccaggtttccttaatggagaaattttgtgctgtttagaatgcatcctctgattcatctgattctgtagggttttggcatttcattgttttggaactattatataattttgtggagttagaagttaacttgcagaaaattcatagaaatataaaacatcattttctttttttcttctctttttttttttttttttttttttttttgagacagtctctctctgtcgcccaggctggatggagtgcagtggcgcatcttggctcactgcaagctccacctcctgggttcacgccattctcctgcctcagcctcccgagtagctgggactacaggtgcccaccaccacgcctggctaactttttgtatttttagtagagatggagtgtcaccgtgttagccaggatggtctcgacctcctgacctggtgatcagcccacctcggcctcccaaagtgctgagattacaggcatgagccaccacgcccagccaaaatataaaacattattttctatatacatgcagataggttctgtccaatggagattcaatggacttttctaacctgctgtggaagaagccaggtttttctgtgttaagcaaattcatgttggcatttttgttggccttttatagttactctttgggatctcctttgaacttaggacatgttaattcccatcttcctaactaatgagctaaataaaatctttgacatgtacattttatatctgtgtaaactcatactcatgatttacttattttaaaaatgatcctttaatataatctacccaatttaaaacttagacaagtttttagagcagttttaggtttacagaaaaactgaatggggcacacagggagtatgcatatatctgccacatcctttcccagttttccttgttaacaacatactgtaccacaccagagaggtacacttattccaattgatgaacctgtattgacacatcattatcgtccaaactacatagtgtacttcaggtttcactcttggtattgtacattctatgggtttggataaatatatagtgacatgtatccacccttctgtctcctacagaatagtttcactgtcttaaaaatcctctgcactctgcctatttatccctccttaccctcaacccctgacaaccactgatctttttatgtctccatagttttgccttttccagaatgtcatatagttggaatcatatgattggcttctttcacttagaaatatgcatttcagtttcctccatgtcctttcatgtattgatagctcatttctttacagtgctgaataatattccattgtctaggtgcgccataatttattctttcacctactgaaggatatgttggttgcttccaagtttgggaaattatgaataaagctgctataaatatcagtgtgcaggtttttgaacagatatatgttttgaactcattttgtaaatgccaaggaactggatggctgaatcatatggtaagagtatgtttaattttataagaaactgtcaaactgtctttcaaagtggctgtgccattctgtattaccatcaccaatggacaataactcctgttgttcaacatcttcaccagaatttggtgttgtcagtgatctggattttggccattctagtgcgtatgtagtagtatctcattttgcttttatttgtatttcgttgatgacgtatgatgtagagcctgttttcatatgcttatttgccatctggatgtctcctttgatgaagtgtctattcagatctcatgcctatttttttaatcaggttgttcattttcttactggtggactttgatatctaaccaattaaaaatttgaactcaacttggctgtacattagaatcatctatagagctttcaaataatacaggtttgacttgtgtacgtccttattactccagtaagtcacatatcactggagggatggtgatggcatacatagctaagtcccatgcagagaacttctgatttgttggggcctgggaatctgcatttctaacaagttcccaggtaacaggaagcactttgagaacacttgctctgcttagtatggattactagtagtacagtttgttaggctctcttctttctctatattagcctgttttaaatttaattgtatgtcccatattttgtttacaattagctatctaagtatatgtgcttttgtaatcatagcttggaattgcgttttctaggttagttttcaaaataatgcttatattctgctaagtccctgccttgtatttttgttaacagactgacagaaattggtgcctggcctatggcctagtggtcttcagaaatgttcttccaaaagctttttaactaagaagacaaaacaccatttctactcaacttagctattatccttttaaataaaactttttgtaaaaatatcccaacacaaacaataagattaaacaaaggatcatagatttctccctaggattatactctctattaagcacagaattgaatatatgtataatcagattttaaaatgagtttgggtctgcctaacctaaaatgtagatgagtctgcctctttctaaaattttaaatcatagtttcttgcagagaaatctggggatgtttaactgaaactttgactttttaaatttgaattttctgaggttgcagttgataatatttaaggtgaatttatttggctataactgaatctttgcactaaaagagagaaatacctgctattttaaataaatccaaaacaacatatctgcaaagctgaataaagtctattttctctcatataagataacgtatttcaaagatgatgagatacggagtaacctcttgatagcatttggttccctcctcattgatgttccactgttatgaatccttgcttaatataatgctcattctccttctaggcttttcttttatctcactataaaatatttttgaagcaaaagtccttctggagtgaacacacacatgtatgttaagactttaaggtatttacctgttaagaaatatttttttaaaaaagaacaaacagaaagcaaaaagagaatcacgaaagattcaaatgaatatttcttattcatttcgaaaagcatgaaatttctatcttagcattcatagatagtattctgagcatgcattttacccttttgcgtgttactttaattttgctttgagacaaaagctgaaaaagaagtatagtatatgtgtgcatgtatgtgtagtttcttctctttttgtagttagtgaaaagaatttacagataatggtatatcagttaaaaccaagcttaaatgtagtgatcactgaggggcaaatttctgctttgcttagagttgttaacaacctcaggtcacctgttacatacctttatttatttgtttatttatttattattattatactttaagttttagggtacatgtgcacaatgtgcaggttagttacatatgtatacatgtgccatgttggtgtgctgcacccattaactcgtcatttagcattaggtatatctcctaatgctatccctcccccctccccccaccccacaacaggccccagagtgtgatgttccccttcctgtgtccatgtgttctcatttttcatttcccacctatgagtgagaacctgcagtgtttggttatttgcctttttttaaattgagaaatcaattatgaatatttacaacactaggcagccaatgactcagataaactgcatttgaacttgtcgtggcctgacaaatgcaggctttagactttattgttagatattaagaatggttcacttttatgagtgaaaaatgtgaaccatcaggaaaccagaaatagtctaggctagaaccttagcaccaccatgaagacttgaacattatgtgaaggggaaagtttggatctcaaagtggattgagctagaagcccatcaggatccaggttcagcatctgggctgtgaagaaaaattatcagacttagaacattaactgagaaagcttgtgttagctttttatttttgcataacaaattaccacacacttaactttaaaacaatgagcgtttattagttcatagtgccgcaggttagaattttatcactgcatagctgggttctctcttcagcgtatcatgaggctggaatgagaatatcatatgacctacactctcctttggagactctagggaagagaccgcttccaagctctttcagattgttgacaaaatctagtttcttgtggttgtaggactgaggttgccagttccttactgactctcagcttctagagactgcctgcattctatgccatgtgcctccagcgcatttccctctcgttgactctctcattcttctactcgctttgattgacttatctgtgattgccagattcagacttgaagggctcatgtgattagtccagctccacccagatagtctctcatttttaaggtcaactgacttggacttttaatatcatttgcaaatccctttccagcgacacctagataagtttaattgaatagttgggagtaggcagtacatcaggggccagggactctggagccatctttgaattctgcctatcactgagctacaagttcaaactcaactgggcagcaagctgtcgagctggcagacacccagatcaaggaagcattgctgcagagtggacatccgatggacagtggaatcttcaatatttcaacagctacacagtgtcccattagaaatgatggtggcgattaccaccagaattggattttctctcaacttgatgtccctagaaggtctgaatatttttggacggagtatgacaccaacatgtgggagcaatttcaggttggtaaagcctcaagaagggatagagagtttcctgacaaaaggacacatagaaaattgagaatgatgtgactttgtattacaaatacacagaggaattcataacatataaacattgttttatggcccagtatgatggctcacacctgtaatcccagccctttgggaagctgaggtgagcagattgcttgggctcaggagttcgagacgagcctgggcaatgtggtgaaactccatctctataataaatacaaaattaattagctgggtatcatggtgagcacctgtagtcccagctacttagtaggctgagatggaggatcacttgagcctggggaggtcgaggctccagtgagctgggatcacaccactgcattccagcctgggtaacagagaaagaccctgtctcaaaaacaagcaagcaagcgaacaacaacaacaaaatacccacattgttttattaacttgctataagctcttgccccacatcaacccttgatatttgccatataatatgggagacatatgattaacagcagagtggggttcagcatccctgcgtcacgtcttactcactgcatgatgtgggcaaattaatcctaaaccttagttttcttttctataaattgggaaataaactagtaccagcacataaattatgaatagtaaataaaatacaacatgtaaaaggcttacagcagactttagttaagtacttgataaatagtcactatgttgagattaagttgtctggttcctaaagttaccaagccattgctatggtttgtatacggtttgtttggccccactgagtctcaggttgaaactggattcccagtgttggaggtggggcctggtgagaggtgtttgggtcatgggatggatccttcatgaatggcttggagttctcttcaaggtaatcagtgagttcttgctctcttagttcccatgagagttcccaaagaactgattgttaaaaagagcttggcatctgccccatctctctttcttctctcttgccatgtgatctccacgtactggctcccctttgccttccaccatgagcagaaggagactgaagccttctccagaagcagatgctggtaaccatgcttcttgtatggcctgcaaaaccataagtcaaacctcttttctttataaattatacagcctaggccgggtgcagtggcttatgcctgtaatcccagcactttgggaggccgaggcgggcagatcacgaggtcaggagttcgagcccagcctagccaacatggagaaaccccatctctactaaaaatacaaaaaaaaaattagccgggcatggtggcgcgtgcctgtaatcccagctacttgggaggctgaggcaggaaaatcgcttgaacccaggaggcggaggttgcagtgggccaagatcgcgccattgcactccagcctgggcaataggagtgaaactccatctcaaaaaaaaaaaaaaaaaaaatacacacacacgcatgcacacacacacagacacacacagcctcagttattcctttatagcaacacaaaatggactaaggtagccatgtaggtctttgatcatttttaaactgattttttttttcatagaataggatctacgttgagtcattcatttactgtccatttgttcattcagttatctaagtcatatttatcaagctgcagacaaagcaactgagatgccaatttaaatgagaaacaaatccctggagcttgtggtgcttacagcctagagattctaaaggggatcattcgcactctcactccacttcattctcactgagattccaagaaaaacttaaagggaacataatggcagttttaaaatagagcaataaagcaattttctcacattccctcaaacactgtaaactcttgcaatttagagacataattttacacatttttgattctacctaaagttagcatggtgggagcacatagtacattgatttaaactaaaaatactagaaacaggtattgtctttaggagaatgagcaataatatttgtgaggaccagtgtctaacgattaggcatcatcttaaacaagaaacatattgatttattacatgaaggttacaggcctaacacaaaagtcaaaatgaagcaacatttactgcaatctatgcttttaagtaatgcctctcaacaaggtcccaggtgttttagaagctgcgctattttagcacaaaataatatactgctgacttttcctcattgcttttgaaacaatatggatctacttttgtctcatttacagaacaaataaaaaagccctagattcagtgagtcagtaaataagacccatttttaagagaaagctgagatcctcagaaaataattggagagaatgacaggggtttatatacaaaggcgtaactcatgacatcattagtatttgtagaaaattacaacttaactacatcactagcaaaaaagaagtggttaagtaaattaccaaatagtcacaaaagtgccatattaggcaacatttacgaatgttcatgaagaaattttattggcataaggagaggcttagggcaacgttaaatgaaaataaaagcagactttggtcctatagcattgcaggatgactatagttaacaataatgtattatataatttcaaatagctagaaagaagatattgaatattcccaacacaaataaatgataaatatttgaggtggtgagtatgctacttaccctgatctggtcactatatgttatatgtatgacatcactatgtataccataaatatgtacaatgtcatttaaaaaatttaaaaagagttgaaaatacacataatatttgcaattatcataatcatatttaatttttttcctatataaaggggctactggttattccatttcagccgaacatcactttagaaaaacagttggtgcagtggttgagtgcaaattgaaggatgtagtaaaggtctccataaccatctggctgagaacagaaatgatttagttacggatttttgttgtatgttactgattggcactcagcatccaaccccatctctttcagttgcgttctatagaagtaggaaacctaaaactcatgtatctgattctctctggaaactatggcactagatgttagattctacaagttagatatacaattatgctgtccggtagaaaggcaaaggtttttttgggggggggggtaggggacgtactgtttataaaaactggaaataaacaagattttattgtagcaccttactagtgagcatcctgtacattttgtgagtgttgaaggcaggggaagtttcttgaaccgggcattccacctcagtctaaaaccaagtgatggcttgaagcaaaggaaaaagcccctcaagtaggtcagttttataaagttctgggagtaattcctggaggcccagcctgtggagtgttcctcctgtaccccagtgaggctgtaggcacttgctgctcggtgttaacccccttcctgctgaaaatatcacgtggtttctcttttctatcctaaaccaaatgaagacaaacagatataacgtgaattctgctattacagggaatattgtacacctttctgtaatgtcattgattatgtttttgtcatgcatgtgttttgagctccttttccataaaaaagtgctcatggtaagcatatacaagaatacacattagtggatacgaggagtgagtagaaagcatgcttgagggtggttataagtgtgtctgctacagactctaaaaaccatttcaaatattttcttaagtcagcactaactatacataccaagataatacattgaataattatcttctggttaccaaatttttcattcaaaaattaataaaggagaaataggtatatattctggaacattattaccttaaccagatactgtctctttctcttttcccaaaactatgtattgttctctagttaccctggccaagatgagaaaaactccaacctcttggtggttgcagaggccctccatgcctaaatattaatagttggaaatacagtctttgtttttactcaagccagcaagcatttatcaagtatatctactggggataaaatagatgctggagatctaatgatgattcagatatgaccctaattctttaaaaaaaactttcactatcttgtgaaagacacataccatgtagtagtgtactggtaaatgtttatcaaccagttttctaagaaaaaaatgtatgtgcatatatatgtgcatatgtttattataaatattattataaataattgcagcacaatttacaaacacaaataaaaatagaatcctccttattgtaagttttatataatgaattgctcctcaaagtatgctttcatcaattttactgaaatcttatatctgtagccaactgatggttgcaattgaggaatgagtgtagtctaaaaatgaatgatagtttatgtttttgtgtatgttaacactatgctaacaagtaagatgaaagggaagcaattaatatgaatcagatcttcactcattcatcaatgacatgagcaattgcttttcttaattgggtaataatttctaaatactgcaaagcattttctggattttttgtgttattcacaatgtaacagctaaaggcacaatacatgttaagtttaatgtgaagtgttaacattttctcaatcactttcttaagtctatactaacaatataacagtaatcaagttctgctttgtaatgtttgtcagtttcaatggtataaatactcccatcatgaacaattgcaagctgctaatggaatgatactgaataaggagttggaaagagaggcatagtacagtacctcattattttagtattcccaccacacaaataaaatagaaacaagtaacttcaaaggcatatataatagtaaaatgtaataagctaattagggagtaaggagttttgagcatttattaaatttatctttaatacaatttaactgtaatttcatagagtttacttttaaataatggctgtatttaacaattagcttttgaaattcactaaaatgtaaggagtggctcttgtgagcctataagggccatctctagcacaacactggatatgtgattggtgataaaggtggaatgaagcatgaggaaaaaatagtcgtctgtatttggggaaaatcaggaaataaatcctgaataggagccagccaggcaacactgggaggtgtagtgaggggacatcccatgcagagcagggagaagggttagtggcagaaggtatcacagcccacttaaaaccttccctcatctcttagcattcgaatggggtaaggtctgcagaagccagattgacaatgaaccttctaggtcaaactgaggtgtgagactttcatcttgtttgagactgacagcctttcagaagttttaaaagcaagataatgcatttgcattttgaagcaatgactctagcagtagtatggagcacagacagtagtaaagcaaagtcatgggtgggaaggccagactggtccatcaacgctgatgttggtcctcttatttgtctttggtcagcatctttgtgctttctctttactgtctttttctaatttgatcctcccattagcaaaggtcaaatcccaaataagtgagagtttttccacccagccatccagatttagaaggctcagaatgtacccaacctcttcctattttttttttttttttttgagatggagtcttgctctgtcacccaggctggagagcagtggtgcaatcttggctcactgcaacctctgccttcctggttcaagtgattctcctgccttagcctcctgagtacctgggattacaggtgtgtgccaacacgtctggctaatttttgtatttttagtagagacagggtttcaccatgttggtcaggctggtctcgaactcctgacctcatgatctgcccaccttggcctcccaaagtgctacaggggtgagccactgcacctggccaacctcttcctattctatgttgactttatacagctacatccaaagtgaagttgttaaccaaaacatcattacagttacaaatttaggaagaaaaatcaaataatatttgatgttattaggaaaagtgatactagagacttgaaacatactaccctcaatgacaatagtgatgcatgcagacagtgttgagaaacttagagagtcgatggaaaatttagtttattttaatttaggctgtatgtagctcaaacatatgctgagcttttataattaaatggagtttctttcgaaagtgtgacagctctttgctttctttctacaagattgaaattagagttggaggacttgtgacttctgaggacagagaagaatgtaagcagcagaaagtttctgggaaactttctagattatgatttgaggcgattatttcactgcctataccccagacacctgctacttcctgtttgatggtaaacttttcccttcagtttttataaagagatatggcatctgggacaattgcttggtcacatgaatttatttgagggaggtcagcatttctagacaactttgatatttaggtgatggaatgaaagtcaaaaaaaccagcattgagattttaatttgaaaatactgagttaagtctttagtgttaatagagctatgtttcccagttttgggatttcatgaggaatatgcttgtagagctgaggaatgatgcaggcattatgaacagaattgaaacaaaccatataaaaaaagctctcatcaaaagaaaggaaaatagcaacaaaacaaaataaataactcttccccctgaaaaaaaaaccctcaaaacgcttgaaaacatgttcatgctgaaaaataatcaaatacattgaaattaaaacaacaatgagatattcttatatatattctaatgagtatatcaaattgaaggttcacaaaaatatatactctcatctactacttttatggtgaacacttttaccatataccttaaatgtttatgtgtcttgaaggtacaccagtctctagaattcatgttcataactggtatataatactgcctctttctgtaaaccgctatgtgttgttggtctttttgtgattggtttatttagaatttcatttgtgttctacaacctatattagatcttaatctcttccagataatacaaaacaaaacaaaaaaatgctttttctctcatgtttcttttagtaatgagacttttatcaacagttaaacatttattcaccccaacttcattccccaaaccactggaggcagcctaccgcaaaatcaaataagtttaaaaggacagtaaaaggacgaaagtttaggaacaagaaaaaaatgaatcataagaagaaggctgcagcatgagaagaaaattagaacggtaatatagaaactgtaaggaactctaccaatggaacagcagagccacgcaattaatagactgggcttggaagtcaaagggaaggagccttgaccagctccactgcttttattcactgagtgctaagagcagctttgcataggatgctccacgaagagctgtgaaataagatgtagacctgaggactgccatagggtcccttgaggtaaatgcactaacgcgtgtctctgaagctgatttcctcactttagaacttctaaatccccgcaaatctccctccaaatttcattctgtctctactttctaatattcatcgcagtcggtcttttaaaaatattttttaaattttattttatttttaattgacaaataataattgtatctatttatggggatacaatgtgatgttgtgatagatgtagggttcacatccattgtcttttgctgtagcctagcaaacgggtctagctttccagcaccagagccagaggaagccttgctttgtgtgggggattggcggggagaagtgaagaaagcaatggggatgcatttggtctcctctccaagctcccttccttccttactttatagcatgcccacttgcaacaagaatcagcctaggacacccaaagtgcctttgcctcactgctgtttgctgcggttgtgatctttctcactggagttgtgaaaaagcagaaagtgagtcctcaatgtgtcaggcctgctgagctactgtgatggttaatactgagtgtcaacttgattggattgaaggatacaaagtattgatcctgggtgtgtctatgagggcgttgtcaaaggagattaacatttgagtcagtgggctgggaaaggcagacccacccttaactgggtgggcaccatctaatcagctgccaaggaatataaagcaggcagaaaaatgtgaaaaggggagactgttctagcctcccagcatacatctttctcctgtgctagagaattcctgccctagaacatcagactccaagtttttcagttttgagactcggactggctctccttgctccttaagcttgcagacagcctattgtgggatcttgtgatcatgtaagttaatacttaataaactcccttttacatatatatatatatgtgtatatataaactcccttttacatatatgtgaatacatatatgtaaaagggagcttatatgtgaacacatacatatgtaaaagggagtttattatatattatatatacatatatattatatatacacacacatatatgtgtaaaaggaagtatatattatatatacatatattatgtatacatatatacatatatatctcatatatatacatatatatctcatatatatttatatgcacatatatatatcctcttggggagaggtcaaaagaagcaggggatacaaatctgactgcaaaaagattgaaggacagtctttattgaaagcctttggtggggatacagaggagtgaattatattgagagataactcagctgaattttctataaattcattgttgctatcttccattttcctaaccacctgctgacttaacctgggttctttctccatttgctctctgactctgcttacctttcctgtctctgtggtgcttctcggtctttctctcatgttccttccattagtctgtctgactgtctctctctgtctcccccagcccccactggatcttcctgcatgttctctccttccagattattctctcttggtgtttgttctatgctttcttgtaaaaaaacatgttggcctctctgggcttttgtaattaatacatctggtcataggggaaaagaatgcttctaaatgttatttgtttttccctgacatgtatcaaattttagttttcactctacctaaagtcccgtctccagtttgaattcaccactcttgctggtggttagataagcaagcaacagacaacgtacacacagaccacatattgagaaacaagggagcctatttgaaattgcagaaattaaaacaacaacaaaaaaaagatgcataaggagctttctgaggagtacatcgcctacccaccaccccacttcaactggaaatctgtttccagtcagcagaaaactgaccaaagacccatcatcaattatactttgtgaggatggttgtctctgaaatatgcagagtggcccagaaattgtagaaaagaagggtttggaaggtccatgcctataaagccaacaagacactttctgcacctcaagaaaagtagtctcgctgttattgtattctgtctgatcaattttccttattttaatgacacatagttttcatgttttgtaatatttttgtcatcacacatggtaaaaagccaacccatatagtctgaggtggaggatgggaaagcataagacattcatacagtgacccttcaaacagtcacagatgacatggttcctggacagtggggcatatctcccagatgaatttcaatgaaagcaattctatagagagcagagaccattgtggcctaaacaaagagcttttcagtgacccaggaagagccaagtatactacttcaggcacctggagcaatggatgacctgaatgtcctcaacacaatcctggatcattatctttactttcaaccagattttgataagaggagatgtagtcagtgatttgtaatcccacagtggtttgccaatggttgctattagcaggaaatcaattcagagatgtcatttgaggatgaagctcctcggtattttgatgcctttttaggaagctaagaggagctccactaccagctcttcagaaaaaatctcctgagttgcctaatttcacctgaatttttggagcacacatttaaaaattacttgtgaatcaaattcaatttgaaaatatgcaacttttttagctcttgctttctccctgagctatttcttgaaaattgtggaggaattgcttctgctcattgggcccatttacatgaattatttatttttatatgtattacatatttgtctctcctccctcctacaagctgttccatagcaagacctctcgtccctatatatattcatggtgacattacagccatcttcaccctctgatgtctaaaggaaatggaaattctgagggtcttcgaaaagcaaaaagccaggtttcctttattctagatttctagaggatttcatagccactaaatctgtaataaccagaagtaacatacatgcatgtacctgggaagttcagtgataagataaatgcatagatgtctttacccatgagtatataatgcatcattttaactatatttttccatttttcggtgttcactttgtagtcatacaaatactagccattgctcattgagtactgtatgtcaggaactatgctatgcatttgtgtaaatcatcacatctctttccagttatcctgcatagtattgttactccatttttttttcctaatgataaaactgaggcagagagaagtaaagtaactttcccaaagttacaaaatcagtaagtcatgatttggtacaaatatgccaaactaccaatctgggccttttaactccactctgctgttgttacattatccttctcttgcacatttaagccatattatttcaatgaaattctgcaaatacttattgagcacttgttatatgtagccattgtcctagttactggggtcacagaatgaaaaagtggagccaaattataaggaggttagattctagtagacaagtcagaaagatgaacagatgaatgtcctacagggcagtacaggtataataagtgtttaccacttaactaaaggtggctcagatcagagaaagacttagtacattatggtgcttcaggatgctcactggtggccaggcagaaaagagtaaagacaatggcattccagcaaaagagagaggcatgggcagtgtcacctactggtgaaataatgcagacaaaaaaccaagaagagtaatttggtactgttgggccataacagatacataggggaatggtgggaataaggatagaaagtgactggggacagacaataaacataattcagtcttacaagtttggatttttccatgtaagttacaaagacccattcaaggaattttaagcagagaaataatcagaacaagtcatgctcagagtaaatataggacatcaaattgtttatcaagaaaaacagtgttttttattatactttgtgttttactggcaatgacatattcagtagatctctttttatctcagttgatattagacattagaaatgaaggctgcggctatattttaaaatggtaaagatcttccatctgtctagataaaattttgttcaacgtttcagtcacttaggtgatggaaatttggctctcctccatgaatcccactttccttgactccttcctactacaatgtcaattctcctgccctttcaaggtagagaaaagtgtttgtagtctcaaagataccagatggtatctttgcctccttttgaaattcatggcacttatgttattccacttttccactcaatgtctttgtcacttgcctatatcctagttgctaccagtgtcacagaaaactctgaaacttgatccttgattctcctttccatttcaactcccaccatcatttttgaccacaccaatatctttgtatgcagtacaataatctgggagtttgtagaaggaaaatggtacttttgactttggggattaagagaagttttaagggagacatgttctgttgctctgctcttccaaaggtaaatgaaactggaattattaaaaattgggagcagaggccacatttcctagttggaagaaacagcacaagcaatggcataatatgaaaagggtggcaggaaagcacataatcctgtgtgattgcatcatagaggatataaaaaggggcaatatgatacagggctaaagtggctaacttgttctacattttagagaaacttgttttaatatcaagagaaggagactgaatttcatttggctggcagtggtggcagggaggtggagatttttgagaaatgtaatgatcaaactgtgccttaagaaggtgaatgaataattttttaggttgggaaagaggatggagagagggagaagatagagtgcaaactgctgctaactattttgcttgttgtccaaagtgtgtctaagatcatctaggcagaggtagcaggaagtagaaggagcacagtgtctataactgcgtttcaaagaatgccaacacttaataactgaataagcttgggttggtattcaagtgaacttgaggaggagtgcctgacaggaaggagggaaaccagggaaatacttggcagtggcaagtagagagaatatgctctaggtcagaagcaccaatagtgttaaaatgaaaacaagaggtcaaataagatgtgaactggacagtaaatattagttataataacatggagatcattgatggtcttagctggttattagatcatttgttagcttcattgggggcagaatctgggagaatttggtagaaggaagtgctgcaaagtgggagactcttgagggaaatttttaaataaacactgttggtataattaggaggggcagatatacattcaaatcctgcttctcaattaattttatgtgtggcctgacttctcgaaatcttagtttcctcccggtggataagagaatggaagccaatgggtcattatgtagaataaatgagatcataagtcaataattggatgaaaagagttctgcgtttgcttgacctaagtattcaataatggtggcaattactatattatttgaatctggacaattgttacatattggaggaggaggttacaggtgtatacataacttgttagttatgttttgactgagaataaaactgttatcaagaaaaacgaggaagtcaaaaagataatctaaagaagagaatgaagtaggtttgtaattttttcccttttaaaaatatgcatgcaatgaaatgtgcagatattttacatttctgtgggttttgacaaaagcttatacacatttaattcacaacctttgaggctatattctatttctattactttaaaaagtgccttcattttcctttgcaggtcactcattctaccaccacctgtgggggcaactactgtttatttctataaccatagattagttttttctactctaggttttttggagtgatatagtacatacttgtttgtttctggcttgtttgaatatactactttttaaatttatccctgtggtttggggcactgatcgtttgccctttttttcattgctgggtttaaatatactaagtataccatattttttttgtttgttttaaaatctatccacttgtttatggacatttttgttgtttctagttttgcgctattttgaataaaatttctgtgaacgtacaccttgtataagtttcactgtataagaaatcatcacatgcccaagccatgtagatagttccttatgtattattttgttttcccaataaactttatagtcagcttttatgtttagagcgggtattcatatagatttaattattgtttgtggctagaattcagtgtagttcatgatttttttctatattaatattaacatgtttcagtgtaatatttgaagtatttttctttctccattgaattgcttcaaatatttttataaatttgtcttttgtttttagaaatatgactattatgtatctagggtctatttttttaatgtgtattctgtttgggattcattgagcttcctctagggatcaatttttttttcccagatcagatttggaaagttttaagccaccatatctttggatatttatttctctgccaatctctttgtcttccttctgagattccagttacacagatgttaaaccacgaagtgacccaggggtcacttagattctgttaatgtttaaaaacttttttccctctctgtactgattttataatttttatttctgtgtattgaagcttactgattgtttcttctgtaatatcccattttctgttaagcccataagataattttacatttcagatattatactttttaattcaagattttccatttggttcatttttatggattccattcatttgatgagaatttctattcgttcactcattataatatccatcctttccaaaatcattgaacatatttataacagctggtttaaagtccttctctattaattcaaatatatgtgatttctctgggcttgtttccaatggcaatttttttctcttggttatgaaagaaatcaaggtactttattatcattggaaccatgatataaatattgctgtgatttgacttgacacagctacaagcaattttgatatgccttggcatcattaatttattctaatttagtgtttaatgtcccagtaataatatttctagcctaagttggtgtagaatagaaacctcagctcttatgcattggaatagaaaaatacgattacacatgatcatgaaaagcaatgatgcctgaatatttggatttgaactgttttatctcacttaaactgagagtgataggttaaaagagtagtgctgcattgagtaaaggctattttgacagaatttgttgaacctgtgtttagaagttaagaaagagaggaagaagaaacaggaacactttaaaagagttgatgccaaagacagacacataaacaaaggtgagatgcttttctatttctctcccaacttaccttagaaggctgtgctgtagcaaacgactcacatttcctatgtaaagcctgttagaaactttttcagactattgaatcgccacaaagagagcaaggtgattttgtataacatcttattcagtatttactagatagctgatacatgcttggcactctaatgacgttgtaatgggtgggcacatccatggttcttcatcgagtttagagactggttagtgtattattttatgctgttaattttacaattgtgtaggtgccaccaagtcctctaatgaacaacctttgctttctgattctagaccaaagatcttctcacatatatctatttcttacatctatttcttattccataatctctcaatctcatgttctttctgtaaggaatgagaatggagatagagttatatagagatcatagaatcttggatgtggctttacagttgtgtttttttcttctgttttaaagggattggggagggaggtcttataagtatatggtgtttcacagatacaacactctgggattccatttcaagttttaatgatagtataagcagtacattgaaagacagccaataacattcatctcttgaaataagtatgctgcagggctgaaataactttggctttattgctttgaaacttcgtgaagcttgggttaagctcttggctatgttacatctgagaaatacagacctcgtttcacctgttccacactacagctgcagttttatttggaaaattgatgagggcattaagttctgaagtcatgttgattctaatgtaaataaatggtgtcattacttcatagttgggagtgccactaatgcagaccttaaaattaagggttatcttgttgattgggggaaaattaaagtaatcaactttcaaggctttaataaatgagattgcacacttaaaaatcattttcaaaccagctttaaaagtagatgactagaaaatcaatagcaataatacatacctatggaaacagaatgggctatatttatttttaaggatagtttcttgtgttatttggtttgaatttattaataaggggcttaaaagtaatcatataaaatattaagtatattttcataggaaaataccaatggtattttttgtggcagttaatacacatagagccatgaaagttgaattttccaaaagaaaaaaatgatggtacaggttcagtacacctaatgtaaattcatgaaatcaaagtatataaaggtttttctaggaagttagaggtagagagggctcaattctattcctgtatgtaatacttgttaatgtgtgtgtgtgtgtgtgtgcatgtgtgaatttgtgtgtagcatttattacattataaaatatagtatataaccttagaaactaagctctttccaatattggaatataaattgctttaaatatttggacacaatcactaccatcactattattatcatcatcatcccagctcatatttatgtagtctgagtctgggccagagagattccatgctaagtcctatttagtatgaagtgggctctcaacctatatctgtgaattaatctttgtgtcaccacaagtgtccagtaggctgatctgaacaaaatcagtactcaggatatgctttgaactgttaacaccagaaggcaagggcaactttcacttttacacacataagggagagtgtattcttcaatttcatgagtagagagtggtgtacgtgagaataatttataaagtgatgtcataagtccctatgtgcctgggaaacacaaacctgcctactccagacaacaactgggtggtttttattattgttgtttgcttttacgtttgaagcagacttgtgtggcacttcagaaacaatatgagatatttagcagtgtataaatttgagtttggagttgattcaggtcgaactttcaacagtaatctgatgtatatgtaatgggatacataattagtagtgtgctgtattgtaaacatggcggaaaaaatgtcagaagactacatgctagacagtcctcattgtctgtcttgccatccccagttcctggggccctggactaagcaggcacaatgggtctgagccagaaaagtccccattgtaagtataatcatagtcattgtaataataaaaatgatttccacttgtttcaatttactacatgccagactctatattacatacttaacatgcatatctcattttaataacaacactgagagataaataggttcaattttcatacgaaaaaaatggaggctgaaaacttggaagtgagaatgatatgatataatgaaaataaatgaaatttgacatcagataggcagcattgcaactcatgattcaccatctattatgtgatcatgggaaaattactcaacttgtctgcgttttaggttcttaaaccataacgtcgggattacttttgttctcctattctgaggatgcattcagatatgtatgtaaaactccaaacatagtacctaagacataggagggcatttgcaaatgttggtggtcctgacctcccaccattccttattgactctgcagagttaatgttgacctgggaagttttcaccctggctccagtaaggaaagtgaaaatgactaatgattttctttatccagtaaaggatgtggaggatggggcggtaaacttgggtacttttctacatcctcctcttttcctggcaaagtcccagtaaatacttatgatagctttgtgtaaaaacagcacctgtagccagacatggcaccatggaaggcaggttggtgggcaaatgccctctaagtgtaaaaaagaaggagtgttgtgggtccccagatcacccaccagatttgatgatttgctagaaaggctcacaggactcatcttgtagtcatatatatagctacaatttgttacagcaaaaatatagaaagcagaattaacaaagggaaaggtacatggggcaaagtttggaggaaactgggtgtaagcttcctagagtcatcctccggtggggtcacacaggattgcttaatttcttcagcaaggagttgtgacaacacataaatgccttccaaggagtctaattggagtctcagtgcctagagtttctataaggggctgctcacctaggcaacttctccatgtaccaaattccagacatcctgaagtgttcagcatagaccatatggtttgcataaacaggcaaggcacgaggagccattcttatcagggaatggtgggaactctcttcaaatcccactttccagacctagccaaggaccaactttgcaagcagacctttatatggatagcagtctcaggccttctcagtttatattaactcatattaacatagtcttagggtgggttacctcttacctgcacagaaagacatagttgcgtgccaggacacaagcatagcagagcaggaaacagatggagttttgccctgacccatctgcgtgtacagatacctttaggcaatgaacaatctaccaaaccatggatggcttccctgcctactagagaagcctcacatggaagagcacgctgtgtatgacctcattctgccttcactctctggtcctttaaatgttgattgatcagccttttttcactgacccaatttgccttctctgaagatgctttttgcaaatacagcaggtttgatgaatgcttagcaagaagtttggatgacttctgcactggtttctgtctatttggggctgattggaaaacttaagacactgaatttatcttatacttgaaattctgtaaccactgttatttatgtctctgtgtctgtctctttctttaatctttgttttgtttttcttcagtaagcagttctgtgaggtagttaggactatgattgggtagttgaggctccatgtggttaagtaatcatatcagaagaatttgttggaaagactcagaccagaatacagatttgctgtttcttgaatgagcatctcttctgttgaatcaaattaatactataaaagtaatttcatggaaagaataatcataaagaggcaatatcagtccaaatacagaaaggccttgcttttctgactttctgtagtagtagcaaacccagtggagttctgaagaatgtggtcattgctatggattgatgttagagaccagagctagattagtcagactggtcaactcttctagagtgactggaaacttaagcatctaagaacaagggcaaatcagtacaaatacagttaacccttgaacaatgcaggtgtgaactgcatgggtccacctatacgtggattttcttctgtttctaccatccctgaaatagcaagagcaacccctcctcttcctcctcctcttcagcctacctgacatgaagatgacaagaatgaaaaccttcatgttgttccactttcacttaacaaatagtaaatatgttttacttccttatgattttcttaataacacatttctttagcttgttttattgtaagaatatagtatgtaatacatataacgcacaaatatatgtcaatagactgtttatgttattgataagctttccagtcagggataggctactcgtagttaagtttttggggagtcaaaagttgtactcagattttgaatgcacagggttttagtgcccctaaccccgatattattcaagggataactgtaatcaagacctgacaagtcctgtctagtcatcaaatcaaaagttcatgagtgaggagagatgtaggagaagaacttaaggatgacagaatgaatacattaaggaataaagtagcaagtaaggaacagacttcaaagtaaggatgaaggtccaattgttttgccaagaactgggcttgggtgttcacttttcatctctaagtctgttttattttagcccatattatctccctcttatttggatataagatgtccagtaagtgggtaacttgcctgtttggaagccactacctgttatgaacaaggcttaacttgttcatatttcattcagtatctcccaaatgttgaaataacgatttgggcaggagagttagttttataaagacatcccaccataaaagatatttagtattcaataaagcttgcagttctttaccttaatgttgtgtcttaatatattgactcaggtctcacttgaaatctgaaacatgggttccatgatctatacacttaataagcctttaaataatgaaacaggatatacttgaagggccagctgtctttgtttctattttatgcctgcattttatgggcttgatcactaggactcagactggtccttggcaacattgcaaagttagcgaagatctttccagccctttcctgacttcctgctacatggaaattttttctctgactgcctgatgctctcatgctgcttgtatttcagtgtctgccttatccctaaaggatttgcctgccctagagttgtcttatgtaccagatctaggtttatcaatattctgggagtcatttgttaagttctcaatgtattccttcttatagagaagtctcttattcacagtctcatatattcggaccagtctagagtacaatgagtgggaatgacagtctggaaggggagaagacaaatgcaataccatctggtgcccagaagaacttctgcatacttaatcagaccccaaagccttatatcatcagcaaagtgggaagcttagtatctcacattcacataatttttagaagccatttcataccttataaattttgtcgcatttcagcaagagttcttgatatgtatttaaacctggactctcttatctaagtgctgtcattgggaaggacacaaagtgttactgggtatttgagacttagtgtggttaagcatattgttgaaaagatgggactatactctataaattgtgagaataatcatgacttctctatttccccgcctgggatattcaaggagagagtgctaaaatgaaaagtaccataaaagctctggagtagcactgacaggatgatggagacatcaccatggtgaaggttgtcctgggttgtgagatacccttaatttgataccttcttcctaaaagattaattcttacaaagtttgtctgtctccaaaatacaagggccctaatatggatcaaacaaataacagggttctcactggcttttatagaaaacataaaatgtcacttgagaatgagaagtccagagggaacacagttctccatgctggaaacagaagacagcaagaaagaaagataaagtgtgatctaaagaaggacacactgctcctgtttgtgtggatagatacaactgagggaagagacaatttgtaactggaaggataaggcagatttatgggtgtttatgtgcctatgtgacaaaagggaccttggggtgtaatgggctagatttaagtatgaagtatgactgcctcatgaaaatgttcattcatggaccttaaatcttgcacataatgaggacaagaaactgtagctgattcatgcaaatgtctccttatatatttcttaatattgcccattttcttgttcactggatatgtgagactctggcttcatcatctcatcctagtagtcaacagattccttcacagcatttactgagtccagctctgggaatatgcagaaggctgaggtaggccttctttcagtctgtcctcatagtcatcaaacctgagagggaaacaccttttcttctttgccttgtgttctctgcatcttactgagaagatgttgtaatgttatgcttttgtttgattttgtttcctcatagagactttcagactcccactatgtggtttggacacgaagtcagtctgagtgccaccgcaccaaccccaaactattgtttctggacccagtgtggtcttttctttcaaggaagaatcttgtccatccagtgcaggggttggaggattacagaagttcttattcctttatgtattatgacccccaagcttgtgagctggtcatgagcctcaaggttttcatccactttccatctcattaggctttcagccatccctgcaaatagcaccatcttcctaaagccctggtcattactccgtaactctccaaacacaagtatttactggtcctgactaagagacttggcttataggggatctgagtgagatgttggcccttattcttagtgagttacaatcttctgagcagacaaatacgcaggaaataataagagactaacagaagataaccaggtggtttggatgatcagtgccattcaatctctgctcaaagctgacatacttaccactaacccaccaagtacagatttgttctccaaattcagaaatgaacaaataattaaaaataatggtaagatgatcccagaaaagattagtgtagaaggagaggggtttgaggagacggtggtaacagcaaataatttgcagctcgagaaagatgatcatgatgatttcacattgatcaaattctatttctatcatatttatatgaattatctcatttgatcttcacaaccctaagatataaataattatcttaacacacgaatgtacagtttggaatcattgtaccaaaaagacacatacactcatatgttcatcacagcaccattcataatggcaaagacacggaatcaatgatgcaccgggtaaagcaaatgtggtacatatacaccatggactgctacacagccaaaaaaaaaaacagtgaaatcatgtcctttgctgtgatatgaatgcagttggcgggcattatcctcagcaaattaacacaggaacaggaaaccaaatactacatattctgacatataaatgggagctaaatattgggtagttagggcataaagatggcaaccgtagaaactggggatgactagaaaggggagagaggaaggacggcaagggttgaaaaactaactattgggtactatgctcagtacctgtgtgatgggataatttgtactttaaatcacagcatcacgcaatatactcaggtagcaaacgtgtgcatataccccaagaatctaaaataaaatttgaataaataaataaaaggttaaaaaaaagaatgtagagcttggaaggtttgatgaaccgtcactttcatcgagaatacaactccaggaagtgagagtgaagtttccagaaaacaaagcagaaaagcagcaagagccacaatgagggtatattttggagtggcggagacctattcattgcttgatcaatggaagcatatttctccccaggaatctgtataatctatatctcagaactttctcccaggggtggaaaaagagataaatatccttgacttgtgtctccctaggccaacatttatcccctgggcctgaactgcttccgtgacagtcaattcatttgcagattcccaggagccacaatagtctgtagggaagcctgggatgggaggtgagaagcagggggtggggtggtcccagcggtgcctgtgtgaagtgggtctgaccccacacacagatgggacaagagtcaggaggtgaagccaagaggatttgaaacgaggcaaaagtgatacctagtccattactgttttctttgttttacaagtgaggaaatctcaggcacagaaagccaggtaagttgtctaaagttgaaatctgagatgtgatagggaggacaatgtaaacacagagattccaaactatcgcatccaaactcccaactactaattcctaatggaaagggttcctcttgaaaactttcagagaatgacctactaggtgacatagactaaaccttcaaagagcatcaacaagaattgtaagaaacctgtgagtgagaagcacttactgagttaccagaggacagtgggaactaagagggtgtctttaacctggaaagcaaccagtgaagccaaccacatccttcaatcccacatcctttgatgccctcacctctcacgcacaatagagatctgagctgcaatttggcacccttaaatgtacttggctatgttccagaacagagaaaaggcaatgttcgtatctgtttcacgcttgcctcgtgccagagactgctcagtatttcacgggaacaacacttcaaggaagttaatagcatctccatcttacggatgacgaaactgaggcttagatgggtaaaggatgttctttgcttccccacattgtttttctggtatatatcacaggcgtatgttttgttttgggtctgtatttgccttctagaatgatattcaagaggtggggttataaaccctggctgggcattagaataatttagggatcttgttaaaattacagaaccccaagctctacctgaaacctaaggcattagacctttttaacctaggggaacggatatcctaatgtgaccatatttcactggggatctgatgggaagccagggttgacactcaaaagaatggacagaaaatagtgaacatgttcctgagctgcatgaaagaaatatgcaagattcagaaccagggctgggggaaaagacagtcctgctcttctttgtacaaatcaaatcacctctgaagaggtgctttgagttttgggtagcttactttaagtagcagaattggaaggaagaactgtactggggaataggactgtgtccagggcaccaagacaaagccagacataacccaagaggctgacaatttggggaagtctggtgacggcaactctctcacccacagttaacaaacaaacaagaaatattttctccgggctcagtctctgtagttttggcagcagggagtcagcgtccttcctgaaacatgccctgctgtgttcctgcccagtcttgccagcagctcagtctgcatctgggcttttccccaccctctgttgcctaatccacagcatccttatccctcccctcaggccaccaccaccccccttctcccacgcacccaggctgtgttttagcaggacagctattttctgccattcagcactgagtgatcatcatcaggtacagcttcccaaacacacaactgcgctgcttgtgtagcctcaggtataattacgaaggctgtcccagcactcgctacctacactatacttaatggggagggatggtctcttgttctctattaaatattttgaaagagaacccgtaggcatgacaaggttcaggcaccaagcagaaatgggaatcggagtgcccctgctctgacaggcaagcacaagttttaattatctgctcatccaggatttaaaaattttcgttttactataaaaagcagaaaaggaagacaacatgatttcatgtgcttacaggaaatgaaattggttgagaatattgtctgctgtcacttctctcttatttcttcctttgtagtgtttatttttcctgttctatgaataataaatactgaaaatataaaaattacagaaatgcataaagatgaacaacttatgaccccacagttcagacaaaacttctattaacatttttatatgttttcatccagtctttttcatgcacactcacacatacccacatagagacaaaagaattgattgtattatggtagtttaatattctaattgttttgttttgtgttacattatgagaaaatatttatgccaatggatacatttgaaaaacaacttttctaatagttctatatttcatgtttcactctgatttatttcactttatttccctgttattggatatttaaattatttccaatcctttgttgataactcttaataaattaataaatcacccaagatattaatcaagctcatcctatgtgttgtcactgttcatgtcagcattgtatgaagagtgaatgggctttggtgactgaaatgataggactaaatactgattctaccactagctcagggcatctaggaaagtcattaaaaatttactcatctgtaaaacagagctcatgctaactgctttgcttatttttctaattttgttctctccatttcctaggacaaacaaacaatgtcagataatctctttctacatattcttactcattctgtttctctgaagttgcaactacacatatactcacacaattcctttgttaacactacctcattctcaaggtcaaatccaaattctacatcaacgtctccctccactggttttcttcatctctgacccttctttttccaggccctgcacggatggcatcaaggtactttcattgactctggctcttcacctatgacttcttatgcctttgagtctgccatttctttttcatgggattttctcctgacattcctgcatccctttttatccagctcctcctcatgactgagaaatcatctctagcctcaactcctcttggaaggattccaaatcccaaaccacaggcagggctaagcaaccctccttgctgactcttagggctgaaccatttactcagtaaaagagatgctctattttgaactttctcaatttgaacgtttggtgctttttccctcatttctggcaacatttcaatgtttctttgctttctccttactatatctctagatatttcttcagctatacatggtcagatgactggagttcactagaggtaaggctatcctaaacctcattattctatggtatctattgacagcgtatgaatgagtctgtgaggcttattacctaatattagaaataaaataaatcaccgaaaaacttgaagcaaagtagttagcagttcatagaaaaatcctgagttagattcctggctcagtcttttaccagccatgtggcattgactgagcctccaagatgtatgttctttatctgtttacatgaaaatcatatttgctaattcttaaagttatgtatatagagttatttctaaatgacatataataatcacttaatgataattttatgagaaactattttcagctacctgttatttttacaaaagaatcacattaaaagatgctgttaaaactatgagaatacatgagatataggtggttattagtatttggcattcacacccaaatatctaatcactaaaattattattaataatgaaaatgaggcagatgatcatgacatttatccccaaatctctagcaccttgcacagtttctggtacgtatttagctcccagaaataaacactgaattgaatttatggtaaaataaatttttagaggctttgatattccatttttaagcatccaatctattctatacacactcatattagcatatttatgtgacaatgaaactattgcaaacagagagaagattattaggttatggatattaagttaatggggaagatataaaatatttaatagcttgggctagaccacatcttttagaagaagaaactgaggatgaaaaaatttccgtgaactgccaggacacaaaatttgagaggggcggagttggaattaaaacccaaccttttctcaagccaattagaatggcaattattaaaaagtcaagaaacaacagatgctggtgaagctgtggagaaataggattgcttttacactgttggtgggagtgtaaattagttcaaccattgtggaagacagtgtggtgattcctcaaagatctagaaccagtaataccatgacccagcaatccctttactgggtatatacccaaaggattataaatcattctacgataaagacaagacacatgcacacgtatgtttattgcagcactatttacaatagcaaagacttggaaccaacccaaatgcccatcaatgagagactggataatgaaaatgtggcacatatacaccatggaatactatgcagccataaaaaagaatgagttcacatcctttgcagggacatggatgaagctggaagccattattctcagcaaactaatacaggaacagaaaaccaaacaccacgtgttctcactcataagtgggagtagaacaatgagaacacatggacccaggaaggggaacatcatacaccagggcctgtcgggggttgggggcccaggggagggagggcattaggacaaatacctaatgcatgtggggcttaaaatctagatgatgggttgataggtgcaacaaaccaccatggtacatgtgtacctatgtaaaaaaccggcacattctgcatatgtatcccagaacttaaagtaaaataaaataaaataaacccaagctttgcctccctaacacaatttagctttccttcatacttcaccagactgatttatctactccacatcaccggatttttgcaggtctttcaaaatctcatttatgcatctaggataaacttaaatttaaatttaattttatgttaagcattgatcaaacttgcaaagtccctctaagtattgtgttgctcttgttattgctgttgccctctctccccacctctaatccaaattcctaatgcttggtctttctttttaaacaaagaacttgttttcatagaaatgaatctcttgtggatttttatgttatatgtcaagctcccttatgaatctatccaaaacatccaaagaataaatcccaggacaggaggaacttgtattcacacatctaattaacctttaattgtctattgtgactgctttgcagttcaatagttgcttgatttttattgcccgcctaattagtgtggttaaagtggctttttaagtcagattttattatatcagtttgcttacgcaatttcgggatactccgggaagttccaataacattgtgattcttaagtgctatatatgtatacacatttgttgtttgtttgctttttctcctcaggaaaaaaagtgctttgaccaatttctcccactagagtgtatgagtagtctatgaaattccttaatgatagcaaaagccttttcattaattgtgcataaattatcaacacagccagtcaattctaattaatcatttttctacccaataaaccaccagattgacagatttagaattctgaaacaaggggagcagtgaaggaaaccacccaaaatactgcaatttaaggcaaactaacatatatgcacatctctaaaaatcagattctacagctgtaatttattagtgagtccatggaatgtagctaattgagtatgcatctatcaggggatggttaagatttaaaataatcaattagatgtacaaatcttattgcataccatggatcttttttcttctttttgtttgctgttttattttctaagtaaagaataaacttgcctccaattatataatttgtattttcacatgttagcattcttttcttgttccacaaactttctaaattactgaaaattatcatgaatgcaatttaattttctacatactgagcactatggttgtctctaatattggccacggttgtagtttcccttagactccctgagctcttgctttattttctttgtctctattctcttggctttaaaatagagttaagcagtttgaattatttctagatctctgtctctctctgtattggagagacaaaagatctagtgcttagcagagtcctcaactcatcactaatagtcaaagtattcagtggcaattgccctgtgtatgaaaacagcagtgcaatacagagtaaaagtactggggcatgctgtctcttgcacagaacaggaaccaagagtaatgggttctattccctactctatgtttgatttactggttagccttgggcatacgatgcttcttaccctttcaatgcgttattctttccatctggaaaacaaagataattgtacttgtagggagggaaaagggagaacctgacataaattagtttggatagaaattatttgcaagattcaaaaatgattctgaaatgtaatccattccacatttattgggcatttcctatgttctaacaattgtgctgagtgctaaagaatacagagtttgccattacattggtgctcattatctgataaggtgtagccatataatggtaattataatataatgtgaaaagttaatattgatgagcccaactatctatttctagcagagagaactgaactaaaatttatttgaaacatcttctgtaactgttggctcatcataaatcaaagtgaattgcatttataaggatagtttgtctattagtaatctgaatgaaggaagacagggaaagacatctggaaaattaccacagtagactggattatcgcttgtaactctttcttccccattgtgaaagaattacacatgaattgtctttaccacttgactttgtagcgactcccattacaattgacagagtgtgcatccgtcttccattgactgtggttttggtgtaatgacttgctgtacccagtggaatacgttgggccaatgaggagacattgcaccagttctgagttgagtcttgaagagtcatgggaagtttctgccagcctgatgggatttcctaccatttgccaggacaagatcatgcttcaagtagctttgctccttggcttatgataagaacaaagaaatgctgcacagactgaactccaccaaaagcctggattccagtctaacccagatgataccagtctagaccagctgaccctcagaaacacttaggagaacaacataaatgctgttgctgtaacctttgcagacgtggggactgtttgctcacaacattatcacggttaaggaaagaagctggttaataaaacatctttttgtaaactcaaacaaaattattgactaaggaagtggtcatcaataaatgataaaactattaggtgagaggttgatgggaaattgagtctttacatggtgtcagactgtaactccacagtttcttgccaggcagagagaacagacataacatcaatggagagatcaagctttcactaccttagtacagtgagtcactaattatgtgacaaccagacaccataatacagcatatgatgacacatcaacttctcagcatgacctatgaagtgtttttgccaaaagtgattaacctgaaattagcagagtcctaggtcccaactctccctttacaggaaatacaagggatagagatagaaattaaataccaccagttaacatcagaaaaattcatcaagcacacgttctataagacaactgactggttacttcaacaagtcaatgttacaaaaagaaaaagtgacaaaggagtggaaaaaaccatattacaatgcaatgtgtgattctagagtggatcccagtttgaatgaaaacagccgagaaagacactggaagacaattgaggacatttacgtatgggtcagcttttagaatcactcagaaattattatatggttaggcttaatatacttaatatagtattgtagttagtagaaaactgtcccaacttttagacatgtataaggaattatttagagtttatagcttatatgtaaataattgacttgaaattacataaaaacagatactaaaattatggcaaagatgttaatgctgattaaatttggagaaaatatattaaatgtttatgattctattctttctaaattgtatatgtttgaaaaattctaaaataaaaatgaccagtggcagtgtacttaggactcatgctaaaatcatttgagatgtcactctgtgtgcaatctggccctatgtttagtgttgtttttagtgttctccaattatttcactcatttaaaggctgtatccagaaggggtcagtaagctgcataaagataagcaccaagttttatacttgttttcacttagcccaaacactcagtgggtatgcgagtaaattcattccattaaagatgatagaaaggactttcttttcattatttgctattacattatgtgactatttattgccctcctttgttcttatcagaggaagcagagactctggttgtgtgtctccttatcctatgaattagttgattaaatcagtccaggcagtacccacttgaagcaatcatgaagccagtcaaccggctggttagagctagtcagagatcacccaccaccactgctccagattttctctacatgtcagataatacagaatggaagaaaacagactgtgtgtttaaataccaaatgggtccacgcagtgtattttttaggtctccatgatgggccaaatatatttagaaaggagaacattatgacttaaatatgtatcaagaagctctcaaccttggtttcagtaataaaaaggtgtccatcatgttaatatcattggattaattgcaccacttttttttgaatcctctaatcaaatgtctcatgcttgtcatgtaattgttgaaataccagacttgattgacagatattgcaaattccccaagggtaaatgtttccaaaggaaaacatagtcatttcaatacagcaattaattataaacagccattaatgacaagtacacaggtctctctctcaacacagaggtcagaaaagtaaggtttttcctgaaagagatgaaaagttgtggttaccatcatacagatataatttttcaaaatattaatgaaaatgatacaatcatttattttcacccaccacatttcaggaaacacactcaatactctaagcatattttttaacagggttgttggtgtggggaggcggtgcttttgactaaaagtcttgtatgctagcaacattattttaaataataatactaataatagttcaggtggggattaaaatataatcaaaacaaaagtaacaaatcagtaagttggtaacatgtgaactgaagccttacatggaagactacatttttcaatggttttttgttttcttggaagggcattaggtaaatttagcatcagatgtcatcagtataaaataatgtaaaatattgaatcaaataccctgagaattcaaggcagaagtagcactatatacatatataagagaaagaaagggagcagggcggctttgcgttgtaattgtctggatgaaagtcgtaatttctacatcactcttaatgtacagaattaaggtccagagtcaagtctggacattatcaggaattgccactactgattagcaataatatttaacaaggaagcaatggaccacacatgggaaaggaaagacactgttgtgaaatgttgacaggaatttatttcttgtccgcaaaactggccgaatgatttatatattgtagttaggaatcagacgagaaccttatgacaattgggaacagtatggattatgatgaggaaacaggaagcgtttcagaatatgttatccacatgtattataagggtgacttttaaggaaaaaaagaagtaaacttttcagtggcagtttagaaacagttgaaaacatgcaaatacagttaacagtaagcacagacatatttaagtcaaagctagaagtattttaaagaacctaaatatctatatgtgtgtgtatatatatacatatgtgtgtgtgtgtgtgtgtgtgtgtgtgtgtacacacacatatagtgagagagccaggtgaaatccaaacatcagaatgtcttcaacatttttccagacatcaaaatactcgaacaattttgcctcatgcatcaaaaataagaattctatcttgtctctcttcccactccaaaccacaactctgaaaggattttccaaaaaattgcttttatcatgttacacctgaaccagataaaataaaataaaattaaattaaaataagcattgatggcagcatatctcaccactctaccacatcaggtctatgatcgccaggtagggctctattccaacatgcttgtcaatatatgattctcttaaactctatatgaatacattttcttcagtttctacttgcagttcttctgcagggggctcagattaaaggatctgggtggagggacaatttctataaatatcatctttatcaccccatccctactggcaccacattcactcctgttactactaatactacgatcatgaagcttacttttaaaatttgaactagctttctccaatcctttcaactttagccaaaaataaaagcctcataacaaactgacccattagggaggttcatcaattattacttaaaaaggtcctaaaaatctcggtttaagttggaattccttctacaacttattatgttaaatttaattgttgacatgctcatctttttttattagactataaaatttcaatggcagaaattatgtgttgttaatttctcttcctcagtgcccagctaatacttaggaaagcatgttatataaaacaacaagtcatcaacaggcatatatgttacaaaaaaactcaaggcaaggaaaataaagaaacacaagtgggtttttggcatgtcattttcaggaaaaagcagtgagtagatcggtttttctaaaatgaagccctctgagttggcatgtagagagagaaagaattgaggtggctgttaggatgttgcctacaggctgttaattatcgccttatttgaaataatcattttactattcagaacattaatttaattttaatggactgacattatgatggtttaattgaggttaaacagtgaagtcttatatttaattaaaagtaaaaaaacctattatagagtattataaaaaccctgtatgtgcctgccaatttttaccccaagaattagctagaaactctcttttcaattgacagtgaaaatttgttctgcaatatctatttggttttacgtatttgttttaaagagtatattcagagagtttcagagaaaagtactaggccaattaattggcaaattcaaaacttcagagttttggccctgcccttcagccccactgcaaaaacctttatctatacttataatggacttttcactgcagctgaacaaaaatgccgcatcttggtaccttatgcatgattttcttatcctaagatatctgtgtatagcttagaagctttgtcttttgacagtaactacatgacattcatcgaatctggtggaattggtaaaataagaatattgtatctctaccaagagagtatcagtgactaaatcttatttttcaattttaagtcattattaagatcctaagaaaagcccagccaaaatatggagacagataagaagctctgtggggttctgagagaagagatgaagctggcccaaccattgtctgatttttttgctctccactgagaatgaaacacatggaaataggattgaaaatgaaacaagaatcagcattggactaacacagctggatgttaggcaaatgcttattatgtgtagtgtttacttttccagaggagagggagacagttgtaatacttaagaaccaaacttctagaaatcaaacataattctatttatgcttctccatcccccaaacagtaaagctcacctttgttaatgtttcttgctttctcaactgtgtttcttgcactgtgctaatatgccttttatctacactatgttatttaattcttttatccaccatgtaagtccctcactacaagttctataaggctgtgtaatttgcccaaattcacacagattctaaatggtgaatattgggctcatatccaggtcattccccaaagtctaacctcttaatgactatttcacctgctaatgaatattcctacattaaattataatacttcattgcaagtaggttttttgtgtgtgactgaatccagtggagttaaaagggatcttcaaaaggcactccgagcacccttatagtttcagcaaaatgacatgaaacctctctccttgtacctctcaaaactctcctcctctctaaataaataaataaatggatagaggttttttcattttatagcacaactttctttagttaaccattccaatatttattacctcttctgcttgtgcctgcctccttgtgtgtaattcaataccctcaaaatgcaatttgattcaaacagctggtccagggatgcaaagtgcctgtcttattctgggttgagcgagtgactagccctgggctggctgctgtggcagggcacaaagaaatgacctcagcccataaggagcttaaaaactagtagataaaatgaggcatttacacattcagcatatagaggctatattgcctgtgtgtaatgaagtggtaagttgagtaatagactaatactaaccagatttcagacagcccacttgaagagacaggagtagctgagggtgtcttcctaaatgagatgaacccatcattggccttgaagaaaactagcttttattgaatgctctctatttggcagaaagcgtggtatatggtagatacttcacttatacttgcttatttgatcttcacaaaatgagcattattatctttttatagtttatagaaaatatggttcaaaagaaagtattgactgtgtaaatccacacagtaagtttttgaattaggccctgtccaacttatctgaatctgtccatctatccatccatccccatccatctatcttttttttttttttgctttttgcattactttacaattgcctccatgattgctatatcttgtgcagtaatatttacaatttcttgcacagaatccgttgcttttttgctaatagctcttctgcttttctttgtaggactgtcccacctcagttctcaatgtgtgttcttcaggtagggctgaaatcttcccatcaactctaggggtgaacaatcagcaaaataagcctcgctgaacacagcgattatttcagctggtataattggtcatttatgtgtgttgagagaaaagggccttctttctgttaaggatctcaactctgaaaataggagtccatggtttttagttgccaccttgctaccgaaaaatgagagggtatttgagaaagacatcatcagagaaaaagcaaatgtcaagtgacagggacagaaagatttgggcactagcatttgcttgcctggtcatgcataaattaactttttatttttgtctcaaccagttggatttgatgttctgccatataaaatcaaatgagcccaggcttacatggagggtattccaagaggggttgacaatttggaggtgacaggatgaaccaaggttaatgatgaggaaaatgacacgttttaaatgaaggcattaaaaatgtaaggctaaagtgaagtagaggtgttacataggagacagtagagcccaaatcccttgcactagctttcattctttgcaataaaggagaattcggttgacccatgaggatggtgcagtgacatttaaagcaccacagcaaaaatgcactgaatattaaatgcactgtagaaataatgtgcatcgtatgtttgtgataaaaagaaagataaatataattgtagagactctatcacaaatagaaaatctcctgtgaaatacacttatagaaacggtcaatgttttatgcatattaaaacattctccaagatgatacaactgccagcagcaccatagttcattttaaaagacaaatacattctaaaaataaaataaaactagcaaacacattatttgttcaaatagtattttgaggtcaaccaagatgcacttctagttccttgcaatttgagggatttttataaaacagactttcaattgagattttgagaaacaccaaggcaagttaaaatcttcatgactttattcaacaaaaaggtggcagcaattttttaaattttgtgtgaaaagtcctacaacagcaaaaatgacctataaaatagttcaaataacagcctcatggcaaaatgactttttcattctcctaagaaaagtcaaacaaagtataaatctattcaaacagatggacttaaattgcaagcattaattcaattcaaactttggtgcattgtctaaaaatcgctgttgagaaatagctttaagtctgaattatcaaaattagtaattaaaattcctaaaacaatccaattcaacagttactgagcaattactatgtgccttactctatttagtatttaaaatacaaataaaattcatccagtccaccaaggaatggccttagtatcctcgtctgtcatataggaatgatgatggtactcataggattgttagaatgagtaaattagtttaatatacataaaacacttaaacagtgactggagcttgacaaatactctttagagggtcattattattgctctgtgaataggtatattcacaaaactgtggaagcattgaagaggtaatggttagttctgtcttgggactagaaaagtcttcaccaagaataaataatttaagtaaacctttaaggatgagtagaagttcactaaatgaaaaagtgtgggtggcctctctagggagagactgatgggtcaaaattctagagccacagtagaacttgatatgttcaggaagtgatgaacaggctgcatttgatttgaaagggtactggaattttattctctagggcataggggataatcaaatttgtcttttttggcagactagtggtataacaagaattagttttaaagttgcccctaaattatcatgtgaatattatcatgtgaatatacatgagtagcatcatatgaaattagaagcacctggcttcaaaccccatctgtcacttagtgacttctctttcctgaaaatataaataataatacttaatttggagacctttcacttaaaagagacatttttagactcccatcatgtggcaggcactctgtggtgcttttctatatatatggtgataagtatataagatttttatattataaaagtgtcagacaatatgattactaatgtgttaatatccattttaaagttttttggtttaattaataaacatcaggcttggttacactcattaatgaaagaaaatatgaagcataacataagcaattaaaatagtataacaataggataataaagcacatcatccatcttcaacagccatcaactcacaccaaccttggttcatctgttgctccacttacctcctctactttctggattaaattgaagcaagttccaaagaactattaattcatttgtaaataattaaatatgcatctccaagagataatgactccttgaaaatatcctaatatcacatctaataaggaattaacaataattatgtaatattttcaaatatccagattctgctcaaaattatattaaatttatttgtctgaatcaagattcaagtaagattcatatggtagttggctgacattgctaaagtctttcttgatcttttcatctcttgtttctgtgaaatttttattttgttgttgtattgttgaagacacgaggttgtgtgtccggcagtttcaccaagtgcagattttgcttattatatctttgaggtgtctttaacaagatcttctagccccaatactttctgtcagttgttggttagatctagaggtaggatcaaagttagatatgtctttttaaacaggagtacttcacaggctttgctgtgtatgtttatcaggaggcacactatgttatttgatctttaatcttgagatgattggtaattatcatttaggactgacaaaaaagcaatattttaattctatcatttcttcttcttttaagttgaagtacttctatgaacagaaatcttcccttatcagctacttggttgagatacaacaggtaaattattgataattaccctttatttataagcttttaaaatcgtatgttgatacctcaatagtctccaaaggtaatcaaagagccttttaaaatatcattatgaatgaataaattgagaaatatctgagaacaccaagcttactagagctcagatatttttcatctttgggcagtgaaagctaagtcaggtaggctcttgaatacttttgggaagtttcttgtcaacatataagatattccagactcatgtcatatatttccttctgcagacctagaattcattatttctccaagaagccctgggtttccttttagtggaaaatagaacctatctagagaccaaaatctaggagtgcagaatgcttattgctattgggttgttcattatttctaggtctttacattgacagagcagaggatactttttttttttagaaaataaaatatattataaatttatactgatgactacaattcaaatttagggttacagtattttaatttaccctcatcaatccttcatttttttttttacttctatgtcaaaaatcttggttttcagcaacataaatgtgattactcatttgccttaatccacactacatataaaacactcactacaaaattaccaccaccaatataattatcaaaaacacagtttatggtttatagttcctgaagtttattttgtccttagggtatatctcagtgtagatatacagtgaaaatactgtgctttataatcatttgcaatagttcttccttctatagtaattccaccaactggatatttaatgaagtttatctgttttctttactttcagaatttagatattgtttttcaaatctaaattacatttaataatcacataaactatatatgtgaactcagagtcaaatcttcaaagactattgagacatgaaaaatgttggttgagctgccacgtttcaccaagggaatttggcggggtggtcactaaattcatgcatttttgaaatttctagttttagaaaaagactgagggctcacccatctagaagcagatctagtttgagaatgaagaaagttggctggcaccaagcaccaagggacagtagcaatgtgaaaacacttcagaaactgctcagatcatttttgctggaagaaaaagtacactaccaagtaatattttaataggtatttatttcatcggaaattttaaaaaatcagccacaattttcttctacctttgtgaaattttgcgtgtgatttacgagttggcattaagagatcacttaatacttgctgttctgccctattctttggcattctatcataaacattttccgtgtggtagcatattcttcctattttcattttaatggctgcatactatttcatggggtgaatggaccttaatttaattagtctgcactaccgtaaaatatttaggcagttttcccttttcttttttttctgttacaattatcttccagtgaacacacgaagctccataaaagtaattttaagcgctttgctttagctgtggcagcagtcgcaagtcgtatttttgatcatctgggtgcacaatactttaccaggtcttgctcaccagttagataaaatatttgctagttatgatgcaaggaagagcaaaaatagtaaatattattttgaaccagctgccaagagaacagatggaatcccacagtatccaaaacatttgacctgaagttgtcctctgtgaccagatccatttcttctcaaaatacatttttcaagcagtagttccctgaccagtagaaaatgctgcttttatctttctcttcttttgtaaatcatactgtatgctatcttgttaaaacaccccatgccagagaagtatgaatgaataaatcttcctgcagatctaggtttccttcaggcataactaaacctggcaaacacactgttaaaatgaccagccacagcactggaccccaagagagctctatggtcttacataataactgcacaacaatcaaagaggccaatagagggggtgagctgggattttttttaggtagggggagggagcggaagtaaaaacagaagaaaatatgagctgcagggctaattggatgtaatttggagatttcaaagaacactgactacaaggtttgaagaggtgcagtatttttgaatgatgaggcaccagaaactccctaggtagcattttgaatttaatttaaatgagaatccagtatttgtgcaaacctggggctgttaggatgcaagactatcttgggattggcattggcaaaccatgcacagagctgtgatgaagaaaccctgtcagaagacggtgcattatggctttagagagtgaatttctagacagtcaaggttgtgtgaaatggggtactttcagcatccctagagatgatgtcttggttggttggatcttggattttgcagattactgatgaaaacattttttggagatataagggactgaaggcataatatgaaatcttactttcaaaaatttctatcagttaagttcaaagagtcattttggggcttatggggatttataatataagtttgtgacaggtgacattattttcttatactgggccttgaattagattgaataattaactgtgatttaagatttgaagaggccagtattttctaaatactaaaacagtggttttggacgttttatgcttcagagatttaattcctgcaagattaatttctttgtaaaacccaaaaagtatctatattttgaatcagacatccagattctttaggaagcaatttttcaccaaagataattgctgctgagatttaaatggatagaatcctagtcaccttggagcatgaaacatgtctaattgtcccatcattttattagaatattattttatttaaaattttgccaacttcattaagacataaagaccaagtgagaaagagcaattcatctaaaataattagctggaatttttcattcatgggtcttttgccaaccttaatcattaacctggactttaacaacttgtgcattcttgctgacagcctgactctcatcttgaactctccaacccaactgaagtttttttcttgagataaactgcacactgactcttcaagtatctgaacggcgggggaaagcttagacaaatagattagtaacaatgctcaggtgtgttgagaaatgggcgaacgaacggctgtccttgactaactctctggatgctcagagagacatttttattgtttcgtgcagtccttgtttaataccatgttttgaaatacactgcaaagttgacaagacgaacagtggagaggtggaggtcttcttatttctttgtctttgtggcaagtgtcaaatctcactttttccctaagattcctagaatgcacagctaagaggaaacatgagaatttatctagaataatggcttaacaattatttcatcatgacacatgagacagctggtggatcatgttgtgcacctcccatgggttattttaaatagttcctcaggtgtttggaatgcgcagccaaatttgtgaataactggctggtggaaagaagatggcaccatatcctcgttgataagataaaagctttagagtagaaaattgctatcattaattttccttcaaactttctctgccccctcttgcctctaagtcagatcaattgtcagcctgcttctctgccttcgctgaattgacagttgctaacacactgctaatggctaactgggacttattgattacagaaaaacgtttggctcattcaaaatcaaagtgataacatgtttgaaaagatgcttaatatatgtatttaaaaacagctctcacaaaagattggttaagggctttaagatacaaagagctgttattaacaaataaagtggacttgggtcgttaacgggtaatgtataagaaaattaaaatgggtgataacattttaaaagaagtttgcctttattaataataagataaatataatttcaaactataacagcatagcactgtgcattaaatctcatttaattggcaaaagggcaaaaatgatgcctggcagtagtgaaatagtgaggtttctacattgcagaggtgttgctaattggcacagccactctaaagaaagattagacgatatggacctaaattcattaaaatgtgtataccgttgaagcagcatttctagtagttagcataagaaaataatttgtcaaatattcaaagatgtttatacacaaatgttcatagtaactttttaaaatattcaaaataaaaaaaaccctcagtggacaccaatgaataagttttgaatatcctttcaaaagactatgagatagccatgaaaatcaatgatacagatgcaagtgtatctatataaataaatctttaataaatatacagtgttaagtaaaaacaccatactataagaccatatgtatgtacgtatgtgtacatatatacaaatatacatacatatctatgtaacttgataaaatttggacgattataaatgaacatattagcaatatgctccctgagatgatcgttttttctctctctagtgctctatattttataattcacttctaaaattttaaaagaacacattattaaatttctgaaaatgaaaaattcctttactttagacaaatgtaacaagaaattatactatttcaaaacttactggtcgtgacctcttaagagtttatttcagtgtctttgaaaagctcagaaagacaactggaactagaaatataggcaggggttttttattctgtccagttcaggataatactaataaactaaaataattccaacgttataggacaagcaaagtctgatttggaaaggtcagtttatgaaatgagagtcgagttaatagcaattctcttccccctcaccccattccattataatttgatcatttaaatgagaagacaaatatattattattacgaaagatgttattaggattcttcccatctcaagcttggtttaaaccccaagagaatagctgccaaccacatccagattccaaagagaggcctgtgggtgccagattaccaaagcaaggtttaccaatgagatagccaagagccagttttacaacccttaaacccttagctgactgtccacctctgatctatagaagggatttgacagattgagagaatgtggtgtagattacaaaagagttttagaaaagatttgtaaggatactgtgtgcccccaacctctctgcccttctggtccccacccctccctaccatgtgggagggatgaagatgcttctccctgatttcaagtctaaaaatgggagtctcgattgaactatctggaacatttgatatgtgtctccctagagctagggtgctgttgcattggtatctagttgatgcctgagagatcaaaaggcttgagattatggctggccagttattctcattcaggacaaagatttgctgcaaggaaaactgcttaaatgcccagagtttatcagcatatagtttatgttttttagggaccaaatgtgaccaagatgggaggtggggaaggagattctggagttgttttaaagggggtgagaaaacctcaacagaaagagacctgtgttgaatgcctacggctgctgagcagagagtgaggagctggaagaggtcatttgccagctcgcaagtaagatgctggagtttccgacaaacccacacatttgacccactgtgagtcccctctaaaagcatgcctccttccgagacagcaccactcactgcaggccacgttcccctgctctaccccgcctctatcctgaagaaacctgtgaatgagggaggagttaacaggagaaaatgaggagtttttcctcaaggccagagctaaaggaagagacatggtttcactttaaactaagttgagcatttggatgactctgttaatgatctgagagtacttttggggactaaagggactggagaaatctttatgatctgagaatgaccagaaaactcacagggcctgcctgcgtgtccagtgtcaggaaaaagactagcgaaagactctctctcctttatttgtatttatcatttaaactaaatcatacatatcaagacacttcacttctaaaatgtaccatgcacctcttaagaatagggacaattgctttcaggaccacactaccattattgggactaaaaaaaaatcaattatcaataatttccaatcatctagtgtctggtatatatgcaaaatttcccaaatgttgcaccagtgtctttgtagctgttgtcatttattcacttatgtatttaattagtatctaatctggttctaattatgtttctttagtctcttttggtctagaatattccattcgttgctttttattccactccattttttaaaaatccaggatattctttttatagaatatcccataatttgtatttggttgattgtttcatcttgttgcaattaaatatcttcttctatcccttatattttctgtaagcttaaataagttagcttcgggttaaatattttttctctgtcttttttgcaagaatagataattgggaatgctttcttattatgtcatatcagattgttctgatattagatatctaagtgtatccacttggctaatattgttactttacagtttttcctttgtagttcataagaaatctaattctgtggttggggaattgtgagtactctgctcccgaaccatttctcaactaatggttttagcactcattaatgatacattcttaataaattacaatactatggacttgaaaaatggtaattttataagtactatatatatatatttgtatttatcagagagtttttctctaaaagaagtttcctttttgttttccttttcttttgtttgagcataactgtgtaactatggacttagggttttttttttttttttttttttttttggagaaggagtcttgctctgtcacccaggctggagtgtagtggtgcgatctcggctcactgcaagctctgcgtcctgggttcatgccattctcctgcctcagcctcccgaatagctgggactacaggctcccaccaccatgcccagctaattttttgtatttttagtagagacagagtttcaccgtgttagccaggatggtctcgatctcctgaccttgtgatccacctgcctgggcctcccaaagtgctgggattacaggcgtgagccactgtgcccggccagggggttttaatttatatcaatgggtttcaattaattaccattgtgattacttttgctgctaaaattatcccaaatttgacaaggaatgttccttcaggctggctcttacatccatttttgagaggcctaataaatacttgctctctcacttattccaggatctccttaccttacaaacctcagacatagaattagctatttctccatatagctctggttcttttcatgggcaatcatatttagaaaacaaaatctgggtgctagatgtgcttactgctattgggatgtcattgcttctaagtctttttagtgggcagaactagaagatatattaaaatggaaatcaattactttgcattgatattttcattaaaaatttaacattatagatttgttttctcctaactttatttatttcatattggtttttctttctttttttttttttttttttttttgacagagtctcgctctatcacccaggctggagtgcagtggcacgatctcggttcactgcaacctccacctcccagattcaagtgattctcctgccttagcctctcaagtagctgggattataggcatgcaccatcacatccagcaaattttttgtatttttttagtagagacagggtttctccatgttggccaggcagtctcaaactcttgacctcaggtgatctgcctgccttggcctcccaaagtgctcggattacaggcatgagccaccgcacctggccagctggtttttctttttattacactgaagatctaactttttgtggattttattttattttttatttattattattttttgagatggagtctcatgtgtcacccagactagagtgcaatggtgggaccttggctcactgcaacctccgcctcctgagttgaagcaattctcctgcctcagcctcccgattagctggattacaggtgcacaccaccatgtctggctaatttttttgtatttttagtacagatggggtttccttatgttagccagactggtcttgaactcctgacctcaagtgatccgctggccttagcctcacaaagtgctaggattacagtcatgagctgccaagcccggcctttttgtggattttaattgtcttaatgggttacaatttgctttatcctaattgtttatatgtgtgtattactattaaatttactgagtgaaatttagatacaacatcttcttggaatacaagctttgcagatagatttaaaaatataccccactaaaatgtagaggtaatactgtcttcaacagatatttgaaacaattctttaatctgcatggtcttatcaattaagttcatttggtaaaccaaatgaattgataaaaccatgcagattttggcacttctgcctgtgttttatcatctgctatctttttcttttaggtaagattttgtttctcaaatatgaaaagcttttacatagttcaaaagttaaatgaatataaaaagtatattcagagaggtctcattcctatcctgtcctttctacccaagtccctatccttatacagagccatttttttaagtttttttttatttgtcttttcctattaccctatcattaattggtgaatgaggcagaggagttatttgcctgaacacacatggccacagagtggaggagataggatttaacccagagcagtctggttgcagaagtaaacccttagctactttgcaaacggcctattaaagtaagactgtgggggaagacaggctttgaaattagcaggttttatcacttgctatctgggtgactttgagcaaattccttaacttctctgaggtttattttacccacttatgaattagggataataatgtttactttgcagagcgtaacaaagaatagagataacttaagcaaattaagttgtagattgtcaggcacatagtaattactcagtgaatgttacccattattataactagtaaaactataatagtacgactcatacagaagaacactagaaacttttattgttcagttgtcactgaagtatgtgttgatctgatctatgttatttagtaagattaaaattttctaagagttgatgaacttgaacaaaaagcaaacaagcctgggtttgataatttatggtttcaaaaatgttaaaataatctcagagggctttgctgattttggttcatttttcaaaatagaagtttcaatattttagtggaaaagaatgttttactactactagaagtcatatagaaacaataaggtaatttctagctgaagtgagttttacgtaaacttgtttaacttcctcattgttttttttttctgtttgcaatataagatattcttatgctcctcatgttttaaagaatttttattctgtgttgaacacaaagaagtttgaaccatgcagaggttgaatttaatttgtataaaatcctcttaatagcatggtctaattaagacacccattacattcatggaatgctaatttaatttggagggaaatgtagttgagcactattgggtttaccataaaattaacacagtggacataaaatggatgtgcttattagatattgttatcagaaatattatatgaatgaaaatcacaatactgctatcttgatggaaataattgttttacagaataaggcatactgtgtgattaactagctaatttatatgaagctatatgagcaagactgttagtgaccgcttttctgaagacaaagattattcaatcgtttttttctgacattagtaaatgccttggcccctgccttagagagtttgttatattggtgaaatttatcatggtagattgaacacattgacttgtattaaggcagcagatctcaaactttttatctcaaaatctttatacccttaaaaattgttcaggactccaaagactttttattgatgtgagttatatccattgctacttacataaaaaattaaaatgaagacattttaaaaatatttttaatttatttaaaatagcaacaataaaatctcatatgttagcataagtagcatagttttttaaaacatgaggatattccaaatgttgacagacttcattgcaaattgtaagaaaattacatttgttaatatcacattcttgaacatctataattactgagaagctttcaatgtgttggtgaaagacacacgtttcagaatttgactttttgcttaaaagctgccagttattttcttcaaagtgacagattcactcattcatttttttaagaaagtgtctgctgagtacttgagtctaaccatagtttattagtcattctttcaataaaaatcatgttaatgtaaaaagcagatagttcatttcacaagtcaaacatttgcacaaatatttttccttgaaataatcactgtgctttgatatgcagcagaactgctttatataaacttcccattttgtcacagagaatattaaaaagatgtgcaacaagtagttgatatgtaaataaacctaataatttttatagcttcaacaagaacattcttatataacattggcattttctcctgcctgcaggcgagtggccttgaaaaataccttgattgctggaagagttcagtgccaaatattcggtgccaaagacactagcagttctacccaaaattccttttgcatcattggcaccaatgccaatacagtgaaaaagtcaaataatgtcctagaattattaggaaaactgtttagaccttgaggaacactacaaagtgtcttggagatccccagggctctgtggactatactctgggaacgctgtagtaagatccatgtttgctcagatgtccttgaatcaggacagagaaagcatttacaaagaaaggtggctctgtttctgctacggatgcagactactctccatgctccctgagaatttggggtactatgagcctttgtaggaagatgcaaaacttttctggccccaaatcccaacagtatacctccttagatggtttttgatataagacttttgtgtcacaaacagtccataaagagggattcactttgaatatttggatggtggaggaagtgagggtgggtagaatatgtaaagaggctcaaatcacaaatcacacaatggtggaacttttgctatcgccacatacttggaaagatgactggagatacaaatatagaaggaaccatttgcaaactaacatagtacaaattgtacttttcttaattctttggattttattatttactttttgaagaacattgttttactttggctaatttgaacaagatatttgttacaaatgggatgagattctaatatcttgtattttaagatccctaaataagcaaggttttgtttcaaatatttagccttggaataaaacgttaacacagtataatataaataattatatttcgttaatgctttttaccacataggtgatgattaagggatgaaaagggattttcattcaggataagctgtttacaagattgaagactttaggaggatcatctgatctgttaccctcactattgtcctccaatccacacaggaattggttgagcataattcagagcaggctgtcaggggaacgactggggcccagaagctaattaatacaaatcacacttaagattttatttcaagtgctgtgcagaagctctttagtttaattaggtcctacttgtcagtttttgtttttgtttcagttgcttttgaggacttagccaaaaattctttgccaaggctgatgtcaagaagggtattttctaggttttcttctagaatttttatagtttgaggtctcacatttaaatctttaatccatcttgagttaatttttatatgtgctgacaggtgggggtctagttttattctcttgcatatggctagcctgctatcccagcaccatttattaaatagggagtccttttcacattgctcatttttgtcaactttgtcaaagatcagatggctgtatgtgtgcggtcttatttctaggttttccgttctgttccattggtctgtatgtctgtttttgtaccagtgccatgctgttttggttactgtagcgctgtagtatagtttgaagttgggtagggtgatgtctccagctttgctctttttgcttaggaatactttggctattcaggttcctttctggttccatataaattttagaatagtttttcttattctgagaaaaatcatattggtagtttgataggaataatgttaagtctgtaaattgctttgggcagtatggccattttaataatattcttctaatcaatgagcatggaatgttttccatttatttgcatcatttctgatttttttcagcagtgttttgtagttctccttgtagagatccttcatctccttggttagctgtattcttaggtatgtccatttttttgcagctattgtaaatgagatgtgttcttgatttgaatctcagtttgaacattattcgtctaaagaaatgctactgatttctgcacaacaaaagaaactgtcaacagagtaaacaacctacagaataggagaaaatatttgcaaaccatacatctaacgaaggactaaaatccagaatctataagaaacgtaggcaaaaaacaaataatcccatcaaaaaaatgggcaaagggcatgaacagacacttctctaaagaagacatataagtggccaacaaaagtgaagcaaaatgttcatcatcactaattatcagagaaatgcaactcagaaccacagtgtgataccatctcccactagtcagagtgacttttattaaaaagccaaataataacagatgctggtaaggctgtggggaaaagggaatgcttatacacagtggtgggaatgtaaattagttcagccactgtgaactaatttgtaaactccagtttggagttttctcaaagaacttaaaacagaagtacggttagacccagaaatccaattactgtgtatatatccaaaataacataaatttttgtaccaaaaaggaacatgcaccactttgttcatcgtagcactatttacaatagcaaaaccataggagcaagttaggcgcccatgagtggattggataatgaaaatatggtaaatatattaccatggaatactacacagccataaaaagtaataaaatcatgctctttgaagcaacatggatgtgctggagaccctaatcctaaacaatttagtgtaggaacacaaaaccaaatactgcgtgttctcacttatagtgtatattagtctgttctcacactgctaataaagacatacataagactgggtaatttataaaggaaagaggtttaattgactcacagttccacatggctgcagaggcctcacaatcatagctgaaggtgaatgaggagcaaagtcatgtcttacatggcggcaggcaagagagtgtgtgcagagaaacgctcctttataaaaccatcagatctcatgacacttactccccatcgtgaaaacagcatgggaaagatctgtccccatgattcagttaccttccactgggtccctcccatgacatgtgggaattatgggagctagtcaagataagatttgggtggggacacagccaaactatatcacagtagaagctaaacattgggtactcatggacataaacatgggaacaatagacattagagacacctagagtagggagagagggagggggacatgggttgaaaaactacttattgagtactgtgcttagcacctgggtgacagtttccataccccaaacctcagcatcatgcaatatacgcatttaacaaacctgcacatgtacccctttatctaaaataaaagttgaaattatattaaaaattatttcataaaacaagcaagttgtcaatttgcaaagaatatttcaagtttaaggcctttattctgtactaggatcttcaaaagatactagacaatttattttttcttttatcaagttattaccttaacatagattgttttcttagttgtgaaataattgtaaattccatgtatttcttttgggggataaatgaaatttcaaatggatttctattggaatcagttgacatctggaattaaaatcttgctgaagtttctgtgattccatctaagatactagattttctttgattttttttgttcttcactgtttctaaagcaattatggtagaaacaagactaaatgatagaagataaatgagacaaataggatgtagttaccagaacattggattgtgcaaaatggaacatttcagctgctatttctatcactagaacattatgacttcatgtggattttagaaaagtaataggtaaacgattccctagctcaagaatctctgaggacagctgaaggcctggagaccaacaataactagagggattcagatgggtgctgggcttgcttgctgaagcgtgcttggctgtgtcctggaacgctgagtagagtctgaagctggtcagagaaggtcataccctatttggcttttgctgttgtaatcttagaatcatgttttcccttattctaacagcttatcttccttgcccattttattagatgccaaactcatataatttttttaacctctaaatatctacttgtataggacaaaaataaactttcagcagccatagtgtatgaaggagtatctgtgattcttccatagtgtagataaagagaactagagaggatacacctcgtcatgcctcaggtcaagtcagcctcccctaaggctctagcggccatcagattgtagtggttatttcctgttccctcctgtctctgtcctccctccccttcatcagggcagcctgctgttcctcgacatcatggatgttgatggtagccccagctttgattgtctttctaccagtcaaccacgcaaagaaggagggagaaaactcttttggagaattccttggcccaatggaccaggcatctcttttcctcagctaagctttccttcttggtatgttacagggaaaggggaagcagtttgccagacagcaagtcaacccggtcttggaatgaggggaaggaggtttccctcggtcccagtaacactctagcagggccaagcattgaaggagtctgcattcaacttgcagaatctgtttagcactttctacacctccatcaggatgtattttattctctggttttagtttcctatctggtttgaagaggagaaaaataaaagtcatgaaacatatagcaagcacctgctccctttgacataagtcagcttgttcaattctcacaacaatcctataaaagagctgctattattcccatttaataacaataaaacggtggctcagagaaggtaaacatttttctaagttcttatacttaataaatctaaatccaaatttgtttttcattcttctttccatatcacactgctatatagttactatgttatcatctcacaatcactgatcaactccgacctttgtcttttttcctgataagtcaccttgttcttggcattgctttccatattcgtggctagcagtgtccttcccagggttagaggcaatgatgagttctttttcttgtgattgctcagtagaaaaggcacgaatggtgctgcaaacctaagacacctccaaacgttatacacttttgctaatagcaggaaaaatgacctctggatgctgccaaagtgagcactgcctttacgtatgatagaaaatacaattatacattttaaaatgatctcacagtcttgctttctaacttgaattcactgtcatttaactgatttataaggattcttggccacaactaaagtatattttaaacttataagtattctctaatgaggaacttttaaaagtccagataaaagcccactattcagtagttagaataattcagtgaaattaaccatgtaaatgctcaatgaagcaaatgattaaagaaggaatgaataaaaataaagattaaagtggatcaaattatattttgtctttttttatactgcttatagatcataattaaatagtggtggctcaaaagcacaaaaccaacctcatcacttaccaggtgtgaaaataatgttgatgtgtatgcttagttttagcgtgacaaagcagatacactttttcacttttaaaaaaaatcactcaatgcatcattctttaatgtttgcttttgtgatgatcactgaatatagaaagtcttttgattttagaataattttaagtctttgcctgctgataacctcagacacagacctgcagccagaattggttgagagttctgctatcttctccaatgagggatatttgagtatatactaaataatcatatttatatactggcatttaaaaaaccaaatattctcatagttctcttcaacctcctgagctccttaatatagataatatagatggccacatttttgtcattatacagtcatgaaaagaagcctatgtaggtcttatccacatttacaagacaggaactgaagatcaaagaggttaagtgactttcttaagttcctcagataaacattttgaaacagctgagatgaaatacaggtgcgctgacttcaaagcacaagttcttttctctagagtgcactacccccaatgagttgacaaaattaaacaaaaactaagcagaattatattttcttacacatacttcatacaagtaatcattaagcagctacttggtactaaagtttctcccaggaggttgcagtgcagatgggtaagtaagctgctgtatgtgcccccaggccataggcatgtcagcagctatggataccacagtaaaataaatgactatcgagaaagcaggaggaacagctcaccaggggagcacagtgatgaagtgaaagcttcacctttcaggaattctacacagcccataaaaaaaaaaactctatcccctccctttcagagtgtttcttaacaactgcttaacacagaaatcatcaacgtattgttgtagatactgggattaatatgtgcagaacttcaaacagaacccagatctcatgactccaagtagaggacctgttccaataacccatgaaaataatcacaacatcctaatcatgttttcatccctgttttactttattagttgttaataggtccattggtcactgggacacccacatgggggttatatacctgttcatacacaagctatgagtctttgaagacagaagcatatgaggtcctgattttgctctagtatgaactcaaacaaattttttttcagactagtcaccctcatctttcaaaacatcagatcatttcagagctgcttctaggacatgtgaacttgggcagagagaattgctttttcttcactgtgttactgtagtgtaccagtcatatggctattctaagatctttaatcctcacttccttgtcaccctcatgaagggtccttcaaacttcttgatgacagccaggggcagggagggcactccaggcagcaagctgacacaatttacaaaagcagttatcttctctcccgtgaagcaatgccgcctggtagaacaaatggtgcaacccatgcacacttagtttatccaccttgataatctaagtgtcaaggacagagcaagtaccattcataagactctctggagcatgcaggatactgacaagctttttatttatgacccagggtttaacccatgtgagctcatactttgtcttctgctaagccttccatagctccatctcaagtcctcctttaaggtgagggtcactggactgcatatcattcagttcccagctagttttctcttcatttatttgtgattttactcagattatgatattattagtttagaaggggttgctgtagtcaggacaatcagtaatgcacttctaaatactaggtagatcctccattctttgtggttaaactccttccaggttctagtttgtttgtttatttatttattggaagattcatacactttgcctttcttttcaccaccttggtttggtttacaagaaccaaagctagtttctctaaacccacttgattagtgtgtgtttgtgtgtgtgtgtatgtgtgtgtgtgtatgtgtgtatatatatatgtgtgtgtatatatatatatatatttttttttttttttttgagacagagtcttgcgttgtcatccaggctggagtgcagtggcatgatctcggctcactgcaacctccacctcccaggttccagcgattctcctgcctcagcctcccaagtagctgggattacaggtgcccgccaccatgcccagctatttttttttttttttgtatttttagtagagatggggttttactatgttggccaggctggtctcaaactcctgacttcgtgaactgcctgcctcggcctcccaaagtgctgggattacaggtgtgagccagcgcgcctggcttgattaatatattttatttctactacatcagacacagattctttttgcccaacatacataaccatgtagtcctacctaatatagtttcctctgtgtgtgtctgtgtgtgtgtgtgtgtgtgtgtctgtgtgtgtgtgtattatatatacaactagtaggaaaccccacatatccacatatctttctagatatcttatctccctattacaaaactcctctctcttgattattacactttataattttactccctatgtcatccaaagtgggactctcattgctgatggtctaagtcagtgagaccctgttgccttggccatatcagagtctctggatgcagggccctggaatcaccattttttaaaagctatgcagtgatgttactgtgaagccaggttcacattttcagcctttagaaaaggcctgttgacctaagttggagaatgctagccttgtccccaaaattgcctgtcttctgtagttattcagtcaatatttattggcaacaatcatgcaataagcaactcaaatgaaatatcctggctaatgtgggaccactctggcacctctgaagttagaggacgtgctactaacatttatcatttcagatctttctgatcgagtgggtaaaaaaagatactggaccattttagttgctatttcactgattttctgagactaggcaaacaaatacacaaagttttctccctccttctgctgttcagtcatcacaaagaaaaattaaggcctttgtatatactgagcaaactgttggggtaaagttataaaaatggcagacagatcttactttgccaaattaagacatttagcaagtattgtaagtgtgatgagtgacgggaataagtgcgggacacacttgctttgtctgacagatgtactaacctgattttgatctgccagagtacaggattcattccttccaggtgcattattccaaagtgcttttggctaaaaggcctcttaaaacctcaatttattgttctctatatagtatatttctatttgccatctctccattattttcacagctatcttgtgtcctaagttgggccctaagaaaaacaaactgtcctaaaccataggccaagatacctgaagaactgaggtggtagggcatggattttgggaaaacttttttatggaaatctctgtcttggaatttctctcaattagcagttcttgtactgtttacagcacgagaactgaaagcataacctgcttctcttatgaggtaaactgcatattctgggtgaatgttttctctccacaaaagccatttcacatgtttccagatcaattttgaagttgttttgacactttacacactttattttaaccttttgtttctgagtgtagtatcctcacctgtctacagcatgaggaattgaaggctctaccctgtctgtttgcctggcagagctggggtgactctgctgcttacacaccagccttcccactagactgaagcttgccaaggcaagggctctgaatgtggaagtgtttccctttccagggccctaaatatttctaacttgtatggcacctgggaacaaatcaaattatcttcttgactccaaatgaacctccaggccttcttagaaaagctgaaagaggaattaaagggggataatggctcatgcctgtaatctcagcactttgggaggcaaggcaggcggatcatgaggtcaggagtttgagaccagcctgaccaacatggtgaaaccctgtctctactaaaaatacaaaaactagctgggcgtggtggcatgcacctgtaatcccagctactcaggaggccgaggcaggagaattgcttgaacccaggaggcggaggttgcagtgagctgagattgtgtcactgcactccagcctgggtgacagagcaagcctcagtctcaaataaataaataaataaataaataaataaataaataaaaagggggagaggggatcaaaagcactagtctgcatccattcagagctatgtgtgcaatggggagtaaagccagcctagaacctgtgcatcatcccaggtgtgtttccagtcctcccttcccaccatgagacaaaatgaatggagacaaatttagatcctctaaaatgagaacaggaggccaaaatggtgggaatatataaacgacaagggcacatatcacttgctttactttagtcctgagatgcccaaggccagactccatggatgagtcttggggcacttttggtcccactctcttagccgtctcccagttcctgcaattcagaggaactccccaaattaattaatctgatgaactctgttctcgagatgacagtatctccatattatctgttcccaagtttcctttcaaaagggacaaatgaacaaggaggagacagcactaagtcctactcatttccaagtaaagcatatatatgctatttcccagcttgggggcaggctgggcaccctttcagtattttatgtctgcatctttgaatgagtctggttgttctctcaagggagttttactttatggctgaaaggaaacctgaagctgatttcttggcctttctctttaactcattcctctttctcccaccaaggtgtctgtaaagattctctctggaattgcctcgcttcctaaaagatattttaaacactaggagtagtgaatgcctactcattttatcaaggaggaaactgaaattcaaatcagaggagggccttgactaaagtcccatggacagttagtcacagttcacacaatggaagtccaagcccagttcactttctgctacactgccttgcttgccataacatcatctttcaattagccgtggtcgttgcctcctatgtatattcaacagaatcctgaagaaagcaagctgaacacgtttccaaattagcgagagcagctctgaataagaagaaaattcatggtaagtttatgggatggctccaggtgtccatctttctatcttcccttgttatcactttccctgttttgggtgtagggggagaaagaatttcccattggctgtctcctggggtgagcaaaaactgaatgtgtttaatctaggttttcctcagattccacgacttgtaataagcacatctttatactcttacctctccagctgttctctgtgcaaagctgaactaactaaaactgctgaaaataccagagctatttagggaatttccctaactgcttcaacattcttaaagtgactaatttaattggatttatagggcactacataataatgatatcctttggctatgttcttagtgggttctacacctgtaatgaaatccataatgaaaaggaaaacagaagtacatttgggatgcaaaaccacttaatttcctggacagccattaaaaatgtggcatccagtgcaataccttaactttgattttaccttcagacacctatgatgatgattctggttgttggttgtgggacattagaataattgtgtcagaagaattcccatcgcatcctagattcacacagcatttctcttactggaaacccaattcattagtcatctgagttggaaaactgggactctaacactggatgttgattttatttatttaatcttttgtgttctggtcttatttctgttgtatttggggggtcctgtctgctatctcctgttcctggtgttgaggtgtagtgttctatggcatttctgcatgtccttggactattttccaaggaatatttgtttaacaaacatccttcaaagatagaggcagtataaccatgaaatgtctccctccagggcaaggttagacaggtttgcttgaagctcccttcatagattgttttctagctttgggatttcttggttttggcaaaatatctatcctgtgagttgtatcaccctgagtccacttctacgtgactcccactctcgtcctccccatgacacttgagtgacaagggcaactgatcaaaacagaaagctcatgctgcctcctgtgttctccttaataaagttcattgtctctgatccaggagtctcatgtcttctgagatcatctatgaaactagcaggttaacttgttggctagcaagtagggttaaatctcagacccttcacagttcttgacacccaatttcttcttttttggagccttagccttagatctagatgattaagtcctgctacatgatcttcatcccagtatttctcccttgcttaagtggctcagcccatatttccagtaccagttcccactaaattacccactaaatgtggttccctccctgtggtcacaaggaaatagagaatttttgtagttctctagaatgggcaggacagacatatttgaatgtatttgcccattctaattatttgatagtgacagtctagggcttatgatggagggattcagtcgttgtatctaaattcagggtgaaaggattgcatgatcaataggtaggtataagaaatggtctagatacttaaagtccaaaacatctgcatcagggctccagagtcaggtgcacccaatgctaaatgatatgaagaactggtaattagagtggtacatacatacaaagtgagctatttttgatgatagtgaagccactatccatttaagtaggtaactactctggttatcacagaggaaaatgtgggaaaatatgccaaattttctccaatcctttctgtaattcctctgtagacgtgcaagtatgatccttctcatgaggtttaagggtggaaaagcacaactaacgtgggcattagtgctataaagccactgttaatttaacaagtttatagaatgtgctggtaatttacaaagtttaaaatggtgacatttctgtctattttccagtaccaggaaaatctgtaagtctcctgaacatttaactttttaaaaataaaaactgtggtacttgttattaacatattctttgctttgcctgttagaaaacctaggaggaattttttctattaaccagaaacagttctcaaactctgatacacattagaaacaccagaaaaatcttaaaattactgatacttgggtttcgccaccccagattctcacttaattggtatgtaatggatcctgagattttttttttcttttttttttgagatggagtcttgctctgtcacccaggctggagtgcagtggcgagatctcggctcactgcaacctccgcctcccgggttcacgccattctcctgcctgattctcccgagtagctgggactacaggcacccgccaccatgcccggctaattttttttctgtatttttagtagagacggggtttcactgtgttagccaggatggtctcgatctcctgacctcatgatcggcccgcctcggcctcccaaagtgctgggatggatcctgagattttttgaaagttcatcatacaattaaaatatgaagcaatgatttgaaaaacactattttataggattttaaactgtctagaattcagttttggactagtatatagtagggatcaaacttttattttcccaaatagccaacttttccaatgttatttatatcttctacttttatttagtagtttttttttcatcattgatctttaaaatgatatccttataaattccatatatctgaatctgtttctggattctctatgttttccacttggtttatttgacaactttttaaccagtatcacaccatttaaattactgcagatttatggagtgttataataactaggagaacaagttttgccttattgcactattttttcaaaatattattggccatgttatacattttatttttcagagaaaaatgtaggagatttcgatcaagtttcatcgtctgatgttttgggccatagggaaccagtcagtctctgtattccagtttgtgaagtacggtgttttgattggtcacacctgagtcttatgatctaaccttggagcaccgtctgagagcacacgatgtgagaacaagaaaggtggttttgggagatagaatgtggtgtcagaactatagagtgagaaaaattagagatggggatcctgttaccttgaagggcagggatgcctgttttgatgcctgaagcatccaaacccagcaatatccctaattttattttgcttttatggtaccaagaatgagtccaggagataattttaaatggtagtgctccaaaaagtgatacatgtacgctacatgaagtggttacaaatgaactattgttgttcatgaactccacatacccatcattaagtgtgcttttcaatactgcattactgtggctgccttcaagattgtgctgtaaaatttccctacattaacttttcacttattcagagcatcccattagtttacatgagagaaaaggaattagaaagataaggagtctaagaaaccttaatagatgggagaattctattaagtaagcataatcaggcaaggagtctcttggaattgaattggaatttcaaggtcacaagtcctatcaatccgctccctctaaaatcaccttctcatcatcctagcagatgagtcctccatccccacatcctacataactgcttcaataaactctcattaaggattccattgaagataccatgttttttcctatctcagggccttggtacatactctttttactgcctaaaaattccctcaccttctttttttccttttgtctagctaactataactcatacattcaatattttcctggtagtattttcttagaaatacttagggagcttagagtgacattcaagctccttcatagtttgactaccacctatgtattgttttggtctatctcctagtaagccaggctagtcacctaaatgccctcctttctcctattgtttatggttgtgtcacttgcatacattacctgcttgtagagcagccctcccactcaggagtaataggttttattcctacgaactaacatgcacttgacttgtacttagtcacattttgactagaattacagggacttgaaggtatgtgttgtgtctggatctgcccatatgttcaaggtatttcttccaagtaagtctgcattactccagggtaagcgccagacttcctcatttttctacctttcatggaacttttgcgtgagtggcaaggaatactcaatggcagtgtttctcaagctttaccctcatcaaaatgacctggagaccttgctaaaacacgattgttgcaaccacccctcataccctgtacccaccaagcctaaatccatctcagatggagcccaagaatttgcatttcttataagctccagtgatatttaggctgccagtgctaaaatcacactttgaaaaccactattccgtgacactgttttaaaaactggttgcatgttaaaatctcctagaaacggttaattaagattttttttttaaagactgtgcttgggctcccctctagacaaatcaagatctctgaggatgccacttttctcatgaaaagaaaaaaattcaacaatccgcaactgttaggagattttaatatgcagctagtgttgaaaatcactgttcatacaaatggcagatgagtaagcagagtcatgaacaagagagcaggcttgctgggagcctaggccagagcaaatgtcataacctcctgaggcagcgtgagttagggcatgcatctcacattttaatgtgcttgcccggaagatgacgatagtaaatctgggatgtctctgaaatgctgctggtctaacaagctcccagatgattcctatccgtgaaccccactctgattagcaaagttgggatatccatgaagaaaaaagggtcagtgcgtgcaagggatgacaaaggcaggtgagtgaaatggggcttgagagcccacatccggtaatcctttagaatttcaaacataagaaagaaggggaagtgctggggggtgggttcccctgtggaggaagttacttctaagccatcagtttaagactttaagtgaatttctggggaaagcatccagttttgataagtctggcccagactaaatatataatttctacctaattaaggaggcaggcacacaggcaaaaaggtaaatgcagcttctggaggcacatcctaacagaaccccagagaaattttatcaaagtctgtgggctttctccatcttcttagctgccttcattgagaagtaaatttccatgggagaaaattagggttttgcttcattcccagtagctggcattaaattagtcctgtagaatgtgtttggagatcatgttgatgagcagagattgtctaagcagcaggtgttacgaattcatttaatcatttaaccacacaccctgcacatatttcagctttcttaggttgacttttatttgcaaaacacctatctgaaggtgtgttatagtggatgtataattgatggtgcttgtcgaattttatgctctataaatgccagatacattttccccaagtatgctctttcttgatccatttctctaaagtaaacatttgaaacaaatttaactcttgagggattctggcaggactcactttctcactgattttagagcttgtgttcaggttggggagagagcattatagtttccagactcagctcagtgtaaaaccatcgtgcccagacaactcacttaaaaggaacaggaaagtgcagttagagagcctttactccacccatctagatgccaggctaccaccaatgggcatcttgttttccctcttttctctctcattggaagagagagagagagagagagaaagagagagagagagagagtgtgtgtgtgtgtgtgtgtgtgtgtgtgtgttttactacctgtagtagtttgaatggtgacctggtgaccctcaaaaaggtatgtctgcatcttgaaacctgtgactatgaccttatttggaaaaagtgtcttttgcagacgtaattagagatcttaagacaagatcatcttagattatccaggtggattctaattccaaggctaactgtccttataagacacaaaagaggagaaggccacatgatgctggaggcagagatgagagtgatgcacctgtagccctagaagcctccagacctggaagaggcaagggacggaatttccctggagcctctggagaaggaaactttgtggagcctgtggaaaccgattttggacttctatcctccaggattgtgacagaataaatttccatttttctaaaagtcacccagtttgtagtaatttgttatagcaaacccaagaaaatgaatatactatgcatcagcttggggtcgggaggtggggcacagaaaaagaaaacaagttcccaggccctcctaaaagtcattttgtttaacatttgatccatgcatttgtcatgccctccaaaggggacttctgcagaaaagttctcagtgtccttcaataagatagagcctttctttgctcctaccctaaccttgaatcaaatacagcttggtgggccctgacgctagaggaattctcagtggctgggctggcggagagctatctatttgtgtatagggttgcagccaaagtctttaaactaaaactaaaactctgtggattaaataaaatactggacatgcaaaagaagattctcttcgggaatccctgtgtactagcccctctgtgtagtgaatgctatcactttttcttctcgcttttctagataggcatctagaaaggtgttcaatctcttgggggtaatccataggcctccagggttatttccaaaagtcttgttgatgttatcagtgttaacacagaacctcttctgattagtgttcaatcttactatggaatagcttttttctctcaaatattattagaaaattagtaaaacataaaaatgatcaggtttggccagttttacccctactgtcctactgctattcaaagacctagcacttctgtacatacgagtaaactgcactcgaaatggtattctctgtttctgcttctacttaggttccaaggcaggtaagcagtctaaccagatgacaggtgagcaatctgaggtgaagtgacttcccattacatgacttttgacccccatcgttgtcttggaaatactttatgctaagtattagaaagaaggaaaacctactggctgttgcaaacaatttaaaataacttaaagtggaagaaagaagaaaaaagcagagtgaaattttatagggtggggaaaacctggaggaaactttcctttgaaagccaggagtccaaactatagataggatagtacagaaattcagcaatccccaagtgttctagcagaatttaaaacagaggatgaaacttggagaactctgggctagttgtgaccttcagatatactttaaaaaaatcaactaatattttaaaatcagtattttcacataagattatgactttttttttcttttgaaaattttgtaagatctggcagcattgggcctttattgctgcattgtcaggaactgggctatgggtgttccttccagttgagggctgtttgaggtctactctgtcatctacctggccagtcccagcaaagctggatgtagttaaacatggaaggcacaactggactaggggaattggataagtccttgaacaagtacctgagttaaaacatcataagttaaaaggaggggatactggtgtgagttctgtttctcaaaaatgggtgtggagttctaaaattaatgttaatttgggttccattttttccaatttccccactctctgccatattgtattctttgacttagcattagacttagataagttagttaatattcctgtaacttcggtgcttcatacacaaaatgggaacaattataactacctcctaagattttagtaagactgaataagacaatggataacaacgacacagcataatgcctgaagcatcataagcacttaaatgttggttgctattatgattggtattctttaaaaagtgctattacttgccattattgacttttgaaactggagggttcaaacaaacaagatgttgagaggctcaggcaaccagtatggttggaaataataagaaagttagttacctaccgtgatactacactaacccttgaaaaaacgtgtggcgtttaaagaaatttctgctaaatttctgtttggcttcagcaaaacctcgtgttccactttcagagcatgaaagaggcagttaaggcaagaaaagcgcatttagaagtttaaagaatgcaagtatcctatgggttgagaaatgagattaatccttccttgactagtgctctttttactggcaggataaattctttaggaaaaagagttatgctggctgtggaagtaaatagtgacaggtgttcttttgtttattttctatgtatttttcaaccccaggtccattttattctcaaatgtaacttcttttcttagtcaacctgctttttggtaaaattgttcttaaagcattcagcttacataattaaatatggttgtgtggttaccttttatatccgaatgtaaggacctccatataatctaattattttttccattaaaaaaagatatttcacagacacaagctataggtaaggattcattacaaaggaatctcattgttttaaatgagcaattccattatttttgattctgccgagagtgggacctaattctgtcaaagagagaaggttgttaagatttggtggtcagaaacacatgacttccaatcaaatttagcagtcctaactatcgaattaggtgttgtaagtttatgtgggctttcctaaggtgaattgactacagggggcatagttctatctaaggaataattagttatgttgagattcaatgttatttgcatatttgtgtctttgaaattcctctgaaaatgagtaatttttagcaattattcttggtgtttgagtccattgagctagtcaaaaatttataattgcaaaaactttggccaaattatcagatagagctaagattcggtttggggtcttaggaattcctattatctccttgaactttgggatgtatcagttattagaatttagacagtcaacgagcttgttgaaattttttttggaacaagatcagtggaatgaatggaaacaaagaagggcatatatttgtagaggaggaaaaggagtgatttgcagaagataaaaaaggaagaagataaaggagaggacggaagggggaaataaaattcacataaattgcttatcactgatattatagaagtaaactattttataacagtatctgcaatttattgttcacatagccttcaaagaaagaaagaaatgaagcagtaaatcaccttgcctcaaattataattttccttacttgtgcaatatttattgagcaattttatgcacagtgttgtgtttagtggtgaggatatgtagcaaataggacaaaacttccgtttatactggtatagtatgtttgtgcacatgtgtggtgatggtgccaagtgactgttgtagaagaatagtgaagaatgaacaaattagaaagtagagaattacaatagagaaggaaggcacatgagcctctcaggagagcttaattctattgctactttcaatggacaataatattttcaaaaggtattaataacttcaatacaaggagtctttcagcctaagtggtcaaaccaagttaagagaaaaggaaaactaaaaataaaaataaaaaataagatcaactttataagcaccgttttgatctcagatctttgtggtaaggcttgggaaacaggactttgcatatgggaagatcataaatctgggcctgtcagggatttgaagagcccataaaagtcagtactaggtgtctctgctgtgctccgaatctggaagattaatgggtaatttcgacttcctgctaattctttatacaaccaggcctatatcttttaagatccaaaagatatattaccataaaaagtttctaagaaaatgtgtaatataacctattctccttctattttcacgttctttctttttctcctgtagtcatcatcagacagttaaaaagaaatggatttttgtcaacttgaaactcaagcttgaataaccagaaataggaatcttccccattatgtttcaaaatgattttcagtgtaccctttcctaactagtcataatttagcttgagaatttcaaatattaacatattagtcattagttggtattatttcaatttttcattcttgtttaaataaattcagcttgtcagctccatatactaattactgtcaatggttttcttttctctataatttaaagtcataaagtagtaataatttagttctttatacatagtttgagcataacccatcgtgagaaggcaagatgtaatcatcactaaacatatttgtttttactaaataacagtttctaaatttgaaaaacttctctgtgggtgatatgtgaggctgacacattgagcaacaccatgagcagatgtagtagcatacgtgaaaaaattggttaagcttcttgatgtttaatgaaatttaagcacaaaaaatatattcatgtataactacttttggcttaataattcatgcatttatttgcctgtaaatactctttaaacttctgttatgtgcaagatatcatcctaactgctataaagcttataaaggtgaatcaggttcaacttctttccttaaataatttacagtccaacctacgcatgtgtataaataatctaccaccagaaaatgctaaataatctaaatggggcatttttaaagtgttgtgtgatttaaatacgtatttgtgtgtgtgagagaatatgatatatgcattcatatatttgagttgaaaatatatacacatttgtgagacagattagatataagcttaaaatgtgtatgtgtgtgcacatgtgcataggagtatatgtgtgtaagggggtaacaaggcgttcacaaatttcattaagagactaccatttgagttgactttgaagcacagataagatttggaagtatggagataaaggatatttgacaatttgacatggtggagagagtatatgaaggtatgagcagagtccagcaggctgacaaattgggacctgttgagaggacaatgataagctgtcttggctaaaagataggagattaatgagaaagaatagtggcaaataagtttcaaaagtaagtgtgtttcagatgttaagtttttattatagatattttgatcttcagtttattgaaatggagttctgagtaggagcaaaggaataccataaaggctacaaaaatgctcttagttaaaagcaggatccactagggttgggttggaactgaaataggtgtttaaattttcagtatcttcagttttgtttgtttttactgtgcttagactgttggatcacacatataagactgcaaagcgctcattaaagtgaaaatatatgcagacgtttatacccggtataacagataaattgagcatctctctacaggtgtatcccaattttttgctatgtatacccttagtggatacctgtgattgaatgtaattattatatcttctggaatgtgagcatacactgattgatgtcagacatttagactgtgctatggtttggctctgtatccccacccaaatctcatcctgaattgtaatccctgtaacccccacatgtcgagggtgaaacctggtgggaggtgattagatcatggggtttctcccatgccgttctcgtgatggtgagtaagttctcatgacatctgatggttttttaacgtttgacatttcctcctacacactctctcttctctctcacgcttctgctgccatgtaagacatgccttcttccccttctgccatgactgtaagtttcctgaggtctccccagcaataagccaggtgtaactgtgaaccaattaaacttctttccttcataaattacccagtctcaggtatttccctattgcagcatgaaaacgtactaatacagactgtggctaacaataaattgtatgtggcaggagggtttcagagtcttgtcatataaacagatatgagaagaggccgtggataatttaaaattccatagcaagcaatttttttttttaaagattcaaaaatgaattgtaagaaggggtgataaaaggaccacctcactggggactattgcttaatctttgcattggctgcacattgcctcatgcattggagacagagcattatttctgactttaaaaaaatccccacacaaagccaagtaatggggtttagtattaggcctacttctattttttttttcctcagagtttgccaaatatttgattttttcagaaaacaatcacccaagagtgcattcattgcttcctgcagaaatgtgccctttattaaaaatagtttatctgggacctgcagtgtgttgaattgtgtcctctagaaatacatgttgaagccctaacctctggtacctctgaatgtaatctttttggaaatggattttgcaatgttaaaaaatgaagttatacttaattaaaatgggccctaaatccaatgtctagttttgttataaggagggggaaatttggagacacttagatgtacatacacacagagggaagagagctgtataaagacagagggagaaactgatgcagctaccagccacgtaatatcaagtgttgccagcaaccacctgaagccagcaaagaggcatggaacagattctctctcacagtcttcagaaagagcatggccatcaacaccttcatttcagacttctaggctccagagctgtgagagaataaatgtatgtggttttaagccaccttgtctgtgctactttgttacagcacaaagaaagatggtacaggaaggaagctggtagagcacagaagaagctggtataggaagctggtacaggagccaagaaacagggaaggaaataggtgggctatatcgtgtttcctgcctgatcattatctccaataaacagatgtgtacattaagagcctttgtaacaaatatgcttaatatttacaggatgcatatattagctggaaaaaaaattacacttttttttctaaaaatattatgttctatccttgacacctgctcagagcttctgcagagagagatttgtgggaaccctgtgtcttaccaaaaatcagcaatcacacaagaggtgtagtgtcctccacaaccctagtttgtgggcttaagaccaggtgccctgattagatcttggacatataatactagaaagactcactcagtacttagtatggcttgttcaagtgttttataggaagtgcaaagggcttagaaacaatagaacttacttgattcctgactttgaaactcattagaaagtgaccttgcactgctgaggaaactctccagacgtcattggtaataggagagtttttaggaggtgaactttaatgtcccttttagctctgtgattcaatgacttaatagatgaataattttcctaaaataagttataaagaatccaaataatagaactagaatttacagtttacttggcagtaagtactggctctcaaataattttaattagttcttgttgaattatgaagtttattttatttgtattttattataaatgaactgcaactcttacttttagatgattttgctaagaataaaggaaaaggaagtaatttgaatttcaaatttttagcccatcaaatgtgaaatgaatatttaaaggtgaacaataaaattaggctgcatttttgaaaaatatttctgcttgctaaaatcagaattatacagccacgacctttaaaataaaagacagaatttcagataaatgcagtggttgtagattatagtttctggagaattctgccccaaatgatatatgctcattcatctttcctttcaaagaacaacaattaaaaaaaaatctttcagtcagttgagtgttctggaatgctaaaataatatgaatggcttccactcttccatgttaaagtgagtcccccaaaggtttacaatctttgatgtccagccatgcttgacttgacatttgaaaattctctagtaaggaatcaaggtaaatggagcataagtttctcttagcaaatttggttttgtagatgtcatactacatgcatgtaatatacatgacaattactccacagattggggcacatgtgttaatgtcacgagagcatcagtgggaaagaacctaaattttgtaatgtaatcgtagtgggatggcagaattatcacataatttatatgataaagcaaaaggaaggccgtgtccctgtaaggattcaggcaatacaagtccacacagagcatttctccatcttagacatctttgcacatcttatttcatccacattcattagctaagtaactcagggatctctgtcttttttgttgctgtttgtatgttctattctgctgccccaatctttagctgatacaacaaaagtatgagtaagaaacagggcatttataacgcactgtagactccatggcatttggacactcagtaatgtgttcttggtactttatgagaatgtgcacagtgatggggtttttgcttagccaaggttttcttcattcagcaacatcatgaaaacgtcttctccttaataaaataataacacaggaatgaagatttctgatacacaatgagcccaggggttgacaaaggaacttaatctttatgaacttgggctctccgggatcgcgccgttgcactccagcctgagcaacaagagggaaactccgtctccaaaaaaaaaaaaacaacccgggctctccaggccgcgccccgaggcctcaggtcggccggctgcccctccctctgctctgttcctagcagggctggaaaggcctctgccgctcagtggggacccagcaaagccaaaaatcaggtccgggggaagagcgaacggtgcgtgatggaggctccgagggggagcgagaggcggaggtcgcacagtgtcctgaggggggagactggaaaagcagacacgcaaccgtgggaagaaacccgaaggagtaaagaactcagagcgaaagtccaaaatctcctcggcacgcgggcctccctgcgggggcgcgggcaccgctgcgcggggagctccggagctgcagagaagcttccactctgcccgcgccgccctgagcacaggcgatgggcctcggagggagtccgcggagcgggacgcctgctgcttggacctcggcgtgagacttcgcgggacgcagacaacttgaatgcgtgtgtcagacccgcgaccactacaagacaacgtccagagacccagccccggaaatgaagaaagacacttccggttctcagagggcgccgttcttccctgagaacacggtccagggaggctggatggccaccgcgtccacggagagagcaccccaggagctccagaaagaacgtgaccacaacgcgcagaaaccaagctgtgaggccaaggtccagcctttcccgcatggcgctttggctcctggggttctgcttgcagcccacaggggccctgaagtgccagggggggaccttgggccaccaggagcgaggcaggccacgatttgagggcttaggtccagagcacctgctgctttgatgctgtttccctcgtagccgggtcctgaatgcccagagactcggcagaacatcagctggtgctactcgccttaaggcacttttgattgagttcttgtcagtttagctactgttcattagtttatgcggaaattgttcttattgaagtttgatgaatggtgttaggtttgtaaggtactgtttttcaaataaagacacatatatgtgtatacatgtacatatccatatatatggtacaggaaggaagctggtacagcacaaaggaagctggtataggaagctggtacaggagccaagaaatagggaaggaaataggtgggctatatcgtgtttcctgcgtaatcactatctccagtaaacagatgtgtatattaagagccttgtgtgtgtatatatatatatatctatatatatatacacacacatatatgtatacatatacatatatacatacacatatatgtatgaaatgagtgagctctggtttattgattatccgatgactggcagttattgaataatccatcttccccttgtctatttgaaatacttgctttctcatattttagttgtcaatgtgtcttggatatatttagacttttgaaaattattttccagtgatttattctagccctgccccaacaggacccgctgtaattttggttgttttattatacatttcaatgttatttaggacaagtccctgtcattattcttcttttgtatacatcatatacgtgtatgtacatatgtatatacatatatgtctatatatacatgtacagatatatatatatatatatatatatatatagagagagagagagagagagagagagagaaactgactgacttgggctctctagagccaccctacttggatgcaactcccagatctgccacttgctagctgtgtgaccatgagcgatttacttagtctctctgtatactgcatgccataaaaagtagaattggaatggcaagaggatcttcctctgaggactgagttaatacatataaagtatgtagaacatcacccttaacataataagcactcgataaatcatagatattattattaatgagagcttaaagatgggtaactagagagacaatctggggaaggagcgtaagtgtgcatcatctgcagacatcacagggagcaattgtataaaatgctacagttgaatcctcacagtttgaatattttaaacttgagatacccagattgagattctcattgtggttggccaatccagagcatgagaaactgaatttcaattattcatatttttgcactcaaagctagctctttcagagctgctctctggaactcaggcaaaacattacagttaaattctgaactcctttcccttcttctcactgaagagaaaattaacaagaagcatgtggataaatgtaaagcaagcagaagagtcataacccttggagagactcaagagtatagttcagtagaaagtcgtcatgtctggccaggcgtggtggctcatgcctgtcatcccaacactttgggaggccgaggcggatggatcacctgaagtcaggagtttgagaccagcctgaccaacatggtgaaaccccgtctctactaaaaatacaaaacttagccgggtgtggtggtgcgcacctgttatcccagctactcaggaggctgaggcaggagaatcacttaaaccagggaggcggaggttgcagtgagccgagattgtggcactacactccaacctgggtgacagcgagactccgtctcaaaaaaaaaaaaaaaaaaaaaagaaagaaagaaattcatctttctttttttgccacgagtagccacaggcacaatcggggatggagaggaacacagatggcatagagcatccaaaagatggcatagagcatccaaaagatggcatagagcatccaaaagatggcagagagcatccaaaaggtggcagagagcatccaaaagatggcagagagcatccaaaagatgggatagagcatccaaaagatggcatagagcatccaaaagatggcagagagcatccaaaagatggcagagagcatccaaaagatggcacagagcatccaaaagatggcatagagcatccaaaagatggcagagagcatccaaaagatggcacagagcatacaaaagatggcacagagcatacaaaagatggtatgggggttgctgaggggactctggagtcccctgaaatcgcataggtctcctataaattcatcagtaccttatattacaacatagtggtcaaggaaaaaaatgtatgctgaaaagtatatttgaatgttgccacagtaagttgctttcctggacctagccctgtgactggaccccagtaaccagagaacaccgcacccaagttaaagaagtgagatagtacaatcagtccaccattcttgagctacctgcctaacagcctggcctatgcagctttttctacatccctgcacatccttctcacctacacattatctctgccagaagggaaatcagcttgttctttgcatgcacccttttttctcttatcattttttttcttgtaatgccgcctatgactgctacaagagaaaacacgacatgaagctgctgtgtccattgcaggttccttgattttgagcaaaggtggaagggacccatggcttcttcacattcgtcaaaggagggaaaggaagctgtcattggaatgtcagacctaaatgtaaacagatttcacagaaaatctttcatacttctcatttaggggaattagtttggattgtctgaataatagatatactaatattgttattgtaaactgaaattttatagaaatataagccctacaattccagatgacccccaagagaaaaatgtgttgtccatgggaagaaaaacagatcaatgaactggaggaatggtgtgacccaaccaccttcactcatagaaattactgtgcttcattcagtacatagtatatatttacattgcaggaaaacaaggtctgggatggttagttttgctccagtagcctggaaaaagcagacttgcctatacttgcagttctggctatgatagactctgtatgtctctaagcttgaatgtaattagaaatcttaatatacagcccatcgggtcagaacctcgaaagggatggatggagacacaccaagtaccatcatttttttctgagttttatcttatatatactagttattggtacttactttatatcttcagaacttagagttttacccatcactgaacacttcatcaaaatgtaagatgttatcttactccctattcctaatgcatagctcagtgctaggtacatagtagtcatttaacactgttttaatgagtagatgaatgaatatgtggatataaaatgtgtgttctacttatataaacatctcaatgcacaggttaaaaactttcaaagtaggaaaatttaaacacatttattttccattctattttatttctaacactgatataatatggcttctataaaaaagaataccaaagggatgaaaatgtagtattatctccttttcacatagctgaacagccactcatttctttttcatatgaaaacatgaagacctagacctattagtaggagccatatcatgggtatttagcaaacgccattttcatctgaaggaggaaaatttagaatttgatctctcagctgccctcagccatgttagaattaaataagtgatcatataggcaacctctaaagtcccatgtatatgcaagactgagacagagagacatagaaccagatagggcaagaggttgaggcaccttagaggttatctagaggagttttcttaggtcttaaatatagaaacttggacccagaaggggcagacagacaacatatttactcaaaataatactgttatagctgttagactaggaatgatgacctggtctcatcgtagaaaaaggcatatgatggtaaatacatagtataatactaaatgttttatatgtcttaatcgtaactatataataacatgctcattaaaacatgactagttactttttacttttttctattttcaagcattctcttgtctaggagttagggaacattttctgtaaagggacagatagtaatttgtttaagtaattggtaatttctttactggcaaagaggccacatactttgcctttgtagcgtgagagtagccatagacactatgcaaatgtgtgagtgtggctgtgttcatgggctccaaaataaggcctggctggatttggttcaatggcctcaattggactacccatgcttcatgcttttaattaatgttcatcgattaaacaaatattatgtaccagacattgtgttatttgctgggatacaaaggtgaataaaagctaattttcatttcattatatcatgccttaaactatagtcattgccttttttttaattaaaagttattcgtgaattattagctctctaaggtaagaaaaatattactttgttggtatctttctagttgatgtaacctgaaggataagctccttcttctaacatgccttaaccaagggaagaaagaaatgcaaatgaattaggtatgctttgagtttatatgaatataactgaccttcttaatatacagggcttaatattattgcttagctctacaaaggaagaacaaaactcagtgtttctgttgaaatttgccttcaaagaaaatggagtcagtgaactacagaatccttgagatcctttgtggaatattcatgcttggcaaatccccctcgggtgtactaatattgctcaaatagagctcaagggatattgagtaaatgctgctacagaggggataagacttcagaaaagaagagtacaaacagaaacttacgtttttacaaagaactaaattgtgtgagtgctaataagaatgcaatctaagtttaatcaggagtggcttgtagaagttaggtaagtacaaatctgaaacattctgataactgtaacagagaatgttctacatgcttggacttggaaaaaaattcttatcaaatgaagttttgagttttacaaatattcaataagtatagactgattgaatgtcctttgtatctttaggtcagtgacctcttgaggcttaagagaaagaaaacatttttttttttgctaagaggtggcccagtggaaatttaacaatctagcttataaagtattggtcctgagttctccagagaaacagaattaacatatgaagagatttgttatgggaatgggctcatgtgatcgctgaggccaagaagtttcataatctgccatctacaagctgaagaaacaggaaagctggtggtgtgattcagcctgagcctgaagctctgggaacttgtgtataactggggaggctggcagtggaggatggaactggtataaatgccaaagtttaaaaatgtgagaaccaggagctgtgttatccaagagaagaagaagatgaatgtcctagcgcagaaagaaagagagatcttcctccacctttttattctcttcaggcctttaaagattggataatgcctgcctacatttgggaggaaggatttttgccttctcagtctactgattcaaatgctaacttctttccaaaaccctctgatagacacaaccagaaatattatcttaccagctatctgagcagccttagcccagtaaagttggcacataaaattaacatcacacactatgaatgaaaaacctcaaaattaaacccacactcagcaaaaatgaaaagtagcctaaggtaaaacctgatacttgtttataattttcaccaccaactgttgatatgggcagaactaatgtattttgctatggaacatggctttccttatatgtgtgaaaataagaaagttgtctttgctgaccctttctttctctgtggaatgttccctcctctattctctgataggagactttttattgcatttcaagcttcagaagttatgccctttattattttctctctctcctgtattttcatcattttttacatacatgtaatgaatcagttatgttctctcgtaaatgtcgtgttctcatgtaaatatcatgttctcttgtctatttccctgtcttctgcaagactccatccaggacgagggccatttcttaacattgcttgagtctgatcatccacttagtattacttaaagcatagtgattagctcaaaacacgtttgtttaataaacatcaaggttgcatctactttcttgttgttacaactgttccccactcatctctagtgattgctattttaaaattctgattcatgtttaatatcaaaaagcctatacattttagtgtaatacttggattcctagtatccctagcttgagataacaacagtatcaaaggctaccctaatttcagcaatgcttttaataaatgcatatgcaaaaagcatttgtgtaattttgaaaagctaataatatatgtaggtgtatgtgtgattgttcagcctacagtagtcagtgtacatgtatgtttctataataaaaacctgggaattaagctgttgcacttaatggggcctttggtactgtggatggggaagactcccttatgtcaatgaaggagttacgtctttctgtagaaattttgtctctttctttctcactacagatcatcaggttgacagtattgaattgatggcaccctaataaggaatagcaattttcatgtaaataattttataaaatactttctttttgctgcttactacttacacaagagaacaaatcagttctattacctaaaagacatactaatattatttagtaatttgtcatttgggctaccttaaattgccagcagttttggtaagtgatatcagctttctctcataaaaatggccattttttttattattacaaataacatgactcatttcagggagaaaaaatataaatttaagtcacctcctttcatcaacattaggcttttcctagtcagggaccccatttaatgtctgcaaaatttaaaattatttttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggagattcctcagggatctagaaccagaaataccatttgacccagccatcccattactgggtatatacccaaaggactataaatcatgctgctataaagacacatgcacacgtatgtttattgtggcactattcacaatagcaaagacttggaaccaacccaaatgtcccacagtgatagacaatgatagactggattaagaaaatgtggtacatatacaccacggaatactatgcagccataaaaaaggatgagttcatgtcctttgtagggacatggatgaaattggaaatcatcattctcagtaaactatcgcaaggacaaaaaaccaaacaccgcatgttctcactcatagatggaaattgaacaatgagaacacatggacacaggaaggggaacatcacactctggggactgttgtggggtggggggagtggggagggatagcattaggagatatacctaatgctaaatgacgagttaatgggtgcagcacaccagcatgacacatgtatacatatgtaactaacctgcacattgtgcacatgcaccctaaaacttaaagtataataataataagaaaaattatttttatctaatcataaaatctacatatgccaacatacagatcataaagaacaagttgtatttatatttcaagggaaaattatgtttactctattacctatcataataatgcttgtctgttgttgtaagccatccatcatcttagaagtaaataattgttgtgctgtaggaaaacacatcaatatagagaatgatgatggtgtgattataataattatcacacatatcataggtagttactaccatttaattctgttttaacatattatagagctagtaaggtcacattaaggagaagacacaagatgaaagacccttaaagaattcttgttcactggaaattacaagaataaaagtctgaagcaaatttggttgacaagtctttttctggctaaactatagttattgatatctagttattgatattatgggtttaagaaggattaaaataactttcagttgggaagaatgttttaagtagtcatctaaaagatgagaaagttgaaaagactaaagacttaggaggctataccatctagatttgtgtaagtacgttctatgaagtttgcacgatgtctaaattgcctaaagatgcattcctcacaatgtaacactgttgttaagtgtcatgtgactctataatacctaggagatatagtttggatattcgtctcctcctaacctcatgttgaaatgtgatctccgatgttggaggtgaggccagtgagaggtgtttgagtctgcttgtttctgcctcaccagaagcagatgctggcactatgcttcatgtacaacctgcagaaccatgagccaaataaacctcttttctttataaattacccagcctcacgtattcctttatagaaacacaaaactgactaacataataggatttggtaatatcatggtgccaagcatccactgggggtcttggaacacatcccccttggataaagggggaattactatctctgtatcttatacctgacttagatggcagggctttcaggattttgccagtaaacataatatgtaagggctgctgggttgtgttacaggtattttatcagttgtgttgtgtgcgtttattcgtacagaatccattggtttctagtttcttgtttctgttatttaaaaaaaatatattaagcatctactaaaactttccaaatacttttctttcttttttcacttttttggagggaaaataatcatattttctcacattctactgttgttttaataaggtactagaattgatttgctaagactttgtttagaatatttgcatattgtaagtgggatatacttgtaatttttttcttcagtcctatattctaagttttcctcatggtgctattatgattttgtaagaaagaattgcatatatttctttcttaatttatataattgattcccaacatgggctgcatatcagaattttaaaagctagaaatgcaagaaattactaaagccagggccctaccctagatcaattacatggatgtagagtgtctgtgatttcagtttaatacagtctaagatttcttctcttttaacttttcaaaagaagtagacaaaaaagagcacttggaagaaaacagggttaatggaaataatgtcatattttctttctgcaagttatccctttttctgtctttctctttctccccccatttccttcccattctcctacaaagaagtgtttgggcaataaattaggtggcagtactctgcatgagtgaatagtttgcactgatactcagtgcttacctatttgtgtcaatactttctgagtatgttccatctgtaaaatttgaaatcacaagttccttctcagctccaggagataacagatgaaatatcaggcaagaaatgagaaggatgtgatgctgattgctttctggaagactcaatttgtaagctgctgggaatccatatctttcccagttgacctttcttgttataccttctgtacatttttttcctctaacataaaaattatcatggggattcgtaggagattgtctgattcttgaaactgcatttgttactttgtgcaatttatagcagctttccacaagtaatttatcagtgcttgttgtttagtgccctgtgacagatctaccagttcacactctcacgagagcactgagacccttcttccatatgcagattttctttcttgattacatttaattctggttctgggatattgctaacagtgatgtcaaggagcatggcatggtgtctcccccatgttctaaggccgtctcagctctaataacatctttctgttgtattaacctgctgttcagtgaattcttagccatctgcttctggcttaggactgtgatttgagtattgtatctagtggatgcaaagggtaagaagatagatgttaaacattctctttctctgtgtgctacttaatttgcttgacatattacaaattgtaagttcctgtgtctgtcaacacatcctcaccacctccagactaacttgcacaagcttcagtgtgttgttggcttaaatccttgctccctccatagttccacccagtgcctaagacgagcgaatagtttccagttcacatgctgattaataaacatcacatttgattagtcatagtaaatggttgtgttagaaagaaccccgaagccatgtatttcctactcagatctcatccaacaggaaagatttagtggctatttttattacctttttcttttttcttttctttttttattttttgtttgtttgttagtttgagatggagtcttgctctgtcacctaggctagagtgcagtagcagtggttcaatcttggctcactgcaacctctgcctcccaggttcaagcagttttcctgcctcagcctcccaagaagatgggtctacagatgcacaccacctcatctggctaatttttgtatttttagtagagatcgggtttcaccatgttggccaggctggtctcaaactcctgacctcaggtaatctgcctgtctcggcctcccaaagtgctggaattcattacctttttctaagtgttatgaaaaacactacttttcatatatataacattttcttattctatgaaatacactaatttacttataacaacattagattttttttaaatctgcactaaaactaaattcattagtgagtttattgtgtattaatactgcaacttatggatactcgaacctgaatttcttgaatctgttactttccactgtaatgtctcaggaaacaagggattttcatgaattatttatactctataagactgaaaacaaaaggtgtcttgccttagtttgaatttaaacttaaaaatcttttcattttatgtttctaataattaaagttagttatgagatatattggaaaatttggaaaacattgaaggaaactttaaatggaagaaaaaagactttacatgatcctatcctcattgttaaaatatttatatacattcttccaggtttttgttataatacatgtttttgtaatgtaattaaaattatcctaagtaaataatatatacatatatatcctatttgtttcacttatcattataacgtaagtattctctaatatttaaaaactatcacattatttttaggggctcataatattccattaaatgattttgtttacttcatctaaccattcctaatattgtttattttcattgatttcttgattttaccataattagcaatgccacaatgatatattttggattattttattttaccagaaattgaattctcaaaacgaaggaaaaagacattatttcaaggctgttactaaattaaacctctttttaaataaacaactgaatattataagatatgtctgtgcaatgtagcttttaaactttgtcattttcctaaaaacgtgagtcacggaggatggtagcaatgatgaccccatcctggcaggtaataaatttttaagtggctttgcactggaaagatggactagatgcgctattgagatctgttgtacgatatgtgctatgaagaagagaaaaatacaggaaatcttcagagggtcgttgatcccagtgaagtactgcatcagaccacatgctgtgtaaatgtgcccactgggatttcatctaaaaacggaggaactaaaaattaccaaaatagtttaacttgaaatttagaaagtttagattacagttaagactatatatgattatcagaagcttactaaaaacatatctcacttttttagtatatttttctgacaaagttcaaagttagtgtaacccttcacttcatgggtgacctgcattgtgttcataaaaagagtctttttggcagaaatcttgcagtatgccagcagttttcccaacggcctgtcttaatgttttgaaattcaaatttttcttctttgaactgtcattttatgaacctcctcatcagtttcctgatctcttcctcttgttaactggtctaactctgccaggaagacattcatgagtggctttgtatgtggttcttcagcatcacttttatgaaatcctggataatttgcagaaaagtagtttcataattcgacccacttgcacttgtgtcttaaagatctgattttttaaaaaaatgacagaatggaaagaaatagatgtcttttgtaaaaagagagaaatgtttgagtgaggattgatttgataaattgtcagtcaattagcaaatattttgtattttgagttctaactaatgttacaacctcaagattgtggctaataaacacgtgggtaaaaaggccatctatgtgctctgctccttctgctcagtcctgtcttccaaacacatgtaagtgtttacatttcacgataacaaatgaaccacataatgaagataatttcacactaaccatgaagcttagctctgcaaagaacaatggttcccagtattggcttcatattagaattgccttggaagcttttaaaaaatgtccatgcccaagccttactcagataaatcagaacttctgaaagagagtcccagataccagtattttttaatgttctttttaaaaggaaagtataaatatgtatttaccattttctgcatctcccatctttaataatttttttttttttgatggggtcttgccctgtcacccaggctggagttcagtggtgtgatctcagctcactgcaacctccacctccaggttcaagtgattctcctacctcagcctccagagtagctgggattacaagtgtgcaccaccatgcctggctaatttttgtatttttagtagagacagggtttcaccatgttggtcaggctggtctcaaactcctgacctcaggtgatccgcccacctcagcttcccaaagtgctgggattactggcatgagccaccatgcccagcccatctctaagaatgcttattaactgtatctgaagatttagtgcctgagattctgcacttataattaatccctatatgactgtaatataagttattctggggaacaatttgagacaatgctgatacatgcagataaaaagtagtagaaaaaaatggtggattaatcttattctatggactagcaattctcaattatttcatttcagtttttacttttcatttcccaatgaatatcataaatgcctattttcaactctccataggacagtggctacttctgtatattaaaaacgaaaactagcatatcaattgtatctgttttgtggtgagcattattggtagtataaggattttaattcagctaatcaaacattggcacatcggtgtgtgatactttatgtttttttccaaaatacagtgtcacaaccatacttatggaacaattgccattaaagtaatgtctagaccagtgcttctaaaacttggttgtgcattcatattatctggggagatcgctgtatgtcagattccgattcatatgactggaacaaggcttaagaaacagcatttctaacaagcacctatattttgataatgttcctaaatcttggaccacaatttgagtagaaagtctgcagcctacactatataaatatacatatatgtatatatgtgtatgtattaatatgtattctttcccgcaagactagatcgtgtaggatagattcttctctggaaattgagcccttataacttccccataattgaattcaattgaaaaatatatttaactactatttattaagggccttttatggacagagcactttaaacatcaaacacgtgatgttattttgtcatactcacttaacttatactcaaggagaagcagtaatttgcccaagtccgcatcatttgaattgacagaactaaagtttatgctcatactggtgtggccccagagtcaataatcttagctactaagcaatgttatcctccccggctcatcagcttcctaccgcctccttcagcccagtgttttcactttcttttgtttatttccgataatgatgaaagattgtttcagcttcatcacaggccatgtagtgcaaattgaagacggctgtctaggcaaggctcttaactattaacattgtggaatacgcacacaagaaaaatccacagttgtgattgtacatttagcacctccacccatactcaagttattattttatacttaaagaatttggatttcctatagggaaaatgacatagccatcatctccatttctgaatgaaaaagtagaggaaataaatgtctcattactggggggctgaaatacatctcatagcagctcctgtaaaggaaaaataactaacatttattgatctgcttttctatgctgagtgttgtgctagccacttcacacatagatcaccctactcagtcctcacaacggtccactgaattattatcttccacacgttacagatgaagaaactgacaagcagggattaaagaaagacttgcctgcagttaacagctgctaaatgatggaggcaatgtttgccttttcagcgaatcaatatagttaaaggaatatagtgtttgtttctctacacgctgcagataacaattttgaatgcattagatgaatttgtaatatattgtgctaaaatagatgtttttattttagaacaaaagaaaacatgtttaatctgatgatcactgcaataactctagcctgattgagattcatgagagtagttatttatatgaggaagataaactaacatttctcaaaaggcacacccaaccaccaatatgttttacatgtgatttataaaataaatattccacaaagtgaaagatatggagtgttttcattattcttgcattttaacatttgtaatatactataacatgataaatgaattaggttatattgattaggtttttgctgcagtcagtaatcattttactttcttatcacttatgcctgagagtagaaattaaacaaatggcttaattacaatgagaggaaatatctttttctattccaagtagtagctctgaagataaaaacagacatatttcactgatgtctaacttctaattgatgataaaaccatgagtatgtcattaagtctgtgtttgtcttgagctatttctggattaggtgagtttttcaaatatctgagtggttgtttctttttcattgctattgtttgattttccctaaatattgctttcactctaaccctatatttccataggagtttttgttctgtgggaaaagttctatggggaagttttattgttctatggaaaagtttgccactttactaatcctgccttcccttgccttaccaactaaagatgagtttaccaaagtctggactccggcacatgtgctggtcttgtctctttttattctccctctctctgcctttattttatttctgttcctatactgtgattatttatttacaaaagttctctattacatgtaagctcttgagggcaaccattatttttttttaatcttttaaattccagctataatacagggtttagcactgaataagctcagtaaacattggtggaattaatgattattaaacgcccaggcagaaaattaattgattgaatattactaacaaactttctctaatttgagctagacaatattaaaatggcaattaacttttcttctctacttatactctcaaatttatcatcatgattgtatattctctaagaaaattaactccataaaattagtcattttaagaggaattccttacattttcatttggatcagacacacggatgcgtctctttgaaggaagtcttcttttctcagcaggttgtttctgactagaatccatttgtatccaaacaatttgagaccctcgttctgctttagcgcacagactttcctaggagcagtcgccattccaatattgtccacggagctggaatgtaattttcagacaagttctgattacaccccagtggttcatgaaactctaatgcatggcagttgtttgagaggattttactagtgaacacctcaaacaagatttcaaaattttatttttgtggggtagagagtgaaatacagagaggtggtgctgagctctgttgtaatacaaaaaagcctcttggcttctaatgcagagagtacttccagaaagaatgataatttagtgtgtgtaaaatcatttctacctagtgtaatactagaataattgttttataaaagaccctgctgttattgtaatggcacaaactggtatgcattaggcccctcttgtttatattagaatatttatttagaactaaatattagaggactcttaggctagagatgcaatccaggaggtgagttgcctgtattttttgcccagttagctttctaagaaagtagaaaaaaaatctttattgtgtactaggaaaaacctgatgtggaagaataagggtctgaaatctcatacagctgccccacatgcaagttgtgtgtccttaggtaattttcataatccctttgataattagaactacaagagaaatttagataatctatcataaattacttattgaagatatttctgctggaatacatttttgagaaggatttattaaatgtcaccttagggctttctcactgattacaagaatgcttcaaactaatattatacagtcttaaaatttttaagaattgagatggcaaacttctactacagtacccttatggagcaaggactggagcttcagcatagaaaacctctagctaaataagctcaccgtattcaaatgtgttgacaaagtgcaggatataggaaaccattctgcaagtcatgacaggattctccgcaggtattttcccctaggatatttaaaataggatgtaattgatggaaatcaatttgcagaatcttatctcgaacacttctgttggcacatctgtacttttatagaatcgtctcttgaggcttatctatttcagtaaagtttctaaatactgtaacgtcagtgtctaggctaaagatatgatggagagcatctaaatttaaaataagagagagtgctaatacgcaggtattaataaaaacttttcatgttcctgctagtgatgtcccttatgggaaactcatgcaacgttatttcatgatgtttatgattttgtaatcactctaaactacagagccattttctcactttctgaatgtgtttattatcaaaacaacattatctgatcttataagactgggtcctgtatttttttaagagctttgagagtagatggcaataataggttctctcaccactctggtttcacattgttccttctgtcttagaagtgtaatttattccctagattcctactttttaagaattcagtattttgcctttcttctttaaaagctaattgtgcatctcttcactctgtacaatgttttcaattgaataaaaacgtgttaaaaggttagtacaacctgatgtttaggagacctacgaatatagtgaaataattcttcataagtgtaaagtacaaatggcctaatgaatatagtcctgaagaaaatgtagtaaattgacttttgaaaataagttcactcttttcaaggttgttttcataggctattcagacatgtattcagggaatcagccaatcaaccagattacaactgaactaaaatgatgaaacaagcatggtgtcaggacctagaaaaaccatgtgactaatacgtggtcccataatcaaaggcacttatttagaaaagagatgattttgactattacctgatagagtcctccatgtaacatgtacctattccatgttttctcatttaagattctcttttcatattgtccatattataaatgatataccattttgttctgtatttaggtcataataattagtttttaattaagctgatcttctccaaaaatatcctacccaattctgctccaactattccagttctaccccttttgcaaattccaacctaaatcttgctttttctgaagtctttttcaatgttcaatcatattagcctatcatgttgcttactttgaattgctctgacataatttgtttttaaacaccatcatgccatacagtgcatagtccattacagtctaatttatggatacgttttgctttaccagtgattctcctgattcacttagattcttctactaccaagagtctggaaaggaaatccgcaactctcaagccagttttcaattccctttgctttatcttgtgaacatgataaagtttcctccttctctgattcttgatattttctactcttaaaatagcatttatcatctatttcatagggaccagatagagccataagtttacatgaggaaaaaaaagaattgactttgtgttagcttcccagttcagagattctcattacaactgtattcctgattgccaaaaggccctttaaatgaaatgcctcctgtaacaaagggaggctctatgtgggctgactttattatccaacagcagggaatatctgtgcattgaaaaaaagaagaaaatgctttgaaagaatacattttacaaagccggtagtaggtcaggggagcctttgcctgactctacgttagagtttttaaattgcttttggatgaggacagcctatttttatttctttgtcatccaacattgttatgataaataattaatttgctatattttatgtttctatcataatccatgttgtgagatcactgtggcattttgctgtaatgataagaagaaataaatggtgctacaatgcttaggaaagattgtgtaatttccagtgatggacagtctgggaaacttagcaaatggctggcctgggtctcacctagtagaaaaagctcagaagagatgagttaaagcgttgtcaattgttcagtcccatcccttcaatggaagtgctgaaaattaaggcacaagtcctaagccctgctgtaagattgtacaattcacaacatttcctagacccggcaacatgactcacagattggtgctgtctctgtctctgtctctctcaccacttgctctctctccccatcctctctctgaaggggaagactccttcagaactgtttttctgtgtagcatggatggaactggagatcattatgaatttgaaattagccaaatccattcttaaatacctcagactgacatacatcttccaaggattcaagttccagctggcatttgaaaacatggctttagaggctcattcaaccctgagattctgtgattgcatgatattctagtttaccttcatcttttccattttttcttttaaatgtaataatgcttccagtgtatattagtcactgacaactaatgaactgtaaaacattttcttatgctttccatagacccatagctagagatgttgacccagtgattaattctaaattgcaatcgatgggtaattattattattattattattattattaggcttttgaataatattgaatatgtccctgaagttagaaatttttccccactttcaaagtgaaagcctggaaaaatagttaagttggttcaaaagagccaaggattttattctttcttatgatactatcctcccaggtaagattttatatctatctatctatctatctgtctgtctatctatctatctatctatctatctatctatctatctatctagatatagaatcacatatagatatagatttaatatctccaattacttgcagaaattcatggagtgctgacgtgctgagagtatgtaaatagtacaccctaccgctgtttaaccttgtggtgaaatcatgtgcactcttcaggtcatgttccagtactttaatcaagttttccatttggtaaactgaaagaccctgtatttctaatgctttgctaatcactataggagcaaacatttattgaatgtgtcttatggaccagacactggtgatgataagaacaattgtatttattctgtttccttgaatcgtcttggccataccttatcgaggtacaatatttgctttcattttgcagatgaggaaacgtagattatgaaatgttaatcaactgactcaatgtatggtaaattctttctatcttactttctcccatttagtttttttctttcatttattgaacaaatatttatttagtttccattatgtaccagatgctgtgctaaacatgaggaatataaggatgaataaaacagaagtggtcttgtcaaaaagtaagtgacggaaatggaattctcacccaggcccactttattccaaggataaactcttcaccacccagtgtgccttcctcccttccttccagccttcctcccttccttccaacctcctttccttcccttcccttccctttccttccctctcccttccctctcccttccttccttccttcctccctctctctctccctccctccctccctctctctctctttttctttttttctttctttcttgcttgcttgctttctctgtgtgattcttcctatatcacaacaaagaatgcaatcatgacagtgaatatgagagaaggttttcttcgtatctgattgactaactcccttctactacttgaggacagtgcagctcagcccttctcccctcccgtcttggattttctttcccctgccatcctagctgcagaaagctcagggacatcagcccattcaaatggtgatatcccatctttcaagatttaaccccctgtatcttgcaaaccatctcactttccaaagccccttattaaattgtccaaactcgctgtttaagtaagacatggccatttccacatgacagaatataaactgctgatagtttttgtattgtattatggggtaaagggacaaatctactgtgaccagtgataatacactcaaagattctcactgcctcaggcactttctgaccaccctgctcagggacaatccatgtctccatacccagtaagtcatgcacagcattccagatagggaagattctttgtgttaattccagtgatggctggctgtagtgggttttatttttcaggtaaccctgagccaggccctgtgggaactgaaatacaagtagaccttcctgtgagttccatacagagatctctcaggaacttgctcttttacctcccggccactctatgataagtggaagttaaaggagttggtttcactctaccactacttcactgtggtgctcagtgtgacatgttcacctggtgttcagaggtctaaaagaaatgaattctgcagtacagagagaaattttaaaagggagagacaaaaggggaaaaaacaggatgaggttagcatatgaaagtgttttctttccctccctttgggctggttttacaatgctagtgtgctagtagaatggctgctttcttcagcactttgttaaaggtccctggttgggtaagaaacttgactgcactaggacacatcaaacaaccagccaggctttggtcttacccaggcactgaaaagctgagccctgtgctctgctctcccatttgccacattttgccggatgagtctggtatgcttcagacaagcagttacacatttcacgaaggaaagaggtcggtggatggaaaattactgtcatttttagtgggtgaaggcaaagaagacctaccttctcttccattgtgagatactgtacagcaccttcgattcatgtgcgtaggtctgaattctgttttcaggatacttagtgttgtgtttgtagaattgaggagatgctacctaggggagaccatggagatccactgaagtggctgcggctgattgtgattgaatttttaagcatttactgaacattcctaatttgtctgtatggaggttaacaacaatttcctacaaactgagtcaaaaggacatattttatttttgtttgtacatgaactttctgcatcgtctgatgaagaccattatcccctctttccagatatcctcattttctttcttctaaatgtctggttgccctttctgagaatttttcattgattcctctttctcttcctagctgtgaaatattataccaggttcctttctcaccctgctcaccaactcactccttccaacttgtgtgttaatttcctcactcccgtaactcatgagaaaaacaacaacaaacaacaagatttgaatgtgttaagctgtaccccatgctgggatagttattttgccactgactcttaggaatcactgcctgatccctgctactctaaattcctgtctcagtttttgtcaataattaaataattaacttttggttatagaaaaacatagacctaagacctatgtttaccccaaaagggaactaacggcgtccatttctctctctgaagcctgagacaattttccggaactccagaattagctatgtgcttgctagtgtttcccatttgatatcctataatcaaatgtgcaaaattgaactcatcttttcttcaccctaaactcgcaattctgcttatatttccatgtttagcaaatgtcactattagctatacacatgctctaattaaaatatggaagtctttcctgatttgtttcttttcctaatacattttctacccagtgattgtgctcctggtaattagtttattgactttggctctgtcctctccatcacttgccaccttattaagaccccattattccttgtccgtgtgatcacagaagtttcctatccggtcttcttgcttacactgttggattcttctaatgcattattcccacagcagctgccagacttgcttttctaaggcataaatatagcctatttatcccttgattttgttctttaatattgttctcataagcaattattacagctggctctaccagtacactgtattttcttccctgagtgctacttccagtttccagtataggacatgagcatgctcttctgacctggaacacatgcaggctgcttgctttctctacctcactaactgctaatcatcttcagaaggcaaggtgatgcaaggaaaagagaatgcactctgattatagcctcagactgaatttccaatcccagttctaaaacttctgagctaagtgactgaaaaattacctaaccttgtttagtatcaatttttgtatctgtttttcagataataataataatagtagctactttaaaaggttagtggattgaggtacatatgtaaagttatctattggtttgacttcttcaagcagccacaactaagttccagcaaaccaaaacaaacaatttattaacaaaactctatgatacttcacaaaattaaagaaaagaatggcaaaaccagaatatatctatagatgtaaagagctaaaactgaggacatcataaccctaggaatcctagggtttttatctctgcttctaagttgcttttaattcttcatctccatggctccaagagataccatatacctagttagccccatcagaaaaactaggggcaatgactctgaatggccgagcttaagttatgtggctaacattagactcatccctatgacagataggataaggagcattaattatctcattttggatcacatgtctatctgtgtggtagaagacctgagccaggaaaaaacgcaataattgtagtcaagagcttctttgtccaatgtacaatacattcttcccatacaaaaaattacaagagtcgttctatttaacataattcaagtatcacacatgcattcatcctcttccaagtagtagaaaacttaaagtcatatccaactattgcaaccagaaccaagtttatagtatctctgggatgtgcattccttttaattatttgctcatatgttgctcattaccttgcaatatatgaacaaaatctatatgtttaaccacatctcagacatgcattatacaacaatgttgagaaaaacaagaaaacagctataaaaattcccacgtaggatagggttacagtggaatccccatatatctgttactggttgaagaaaataatatatgcatggacaagaatagtaaggagcagacattggttggcttgaacctttccagttgagtcaccattgcttattttccccatctgacctttatggtacttcttctgagcattattctttctggctgcacctgagggggtctttaggaaagactccctggggactgtacatttttctgtgcttctctagtgtagtcacaaggtgctaacagttactttagaagttagcagatgtatcttagaaacatgttggatttacttgggaattcaattacataaaagtcaaattggccacctaatttggatgtttttatgtgggtagatctggtttgtttaaaaatcaaacaaccagaattattattcagttgtaaactttaaatctgaaccctgaccttgcaaattctaaccttaataaggctcttcatgttttgcccatttcactaggacttattttaaagctttcaaccacagaatcctagattggatactaagaaaggatgaacagctgttctgaagctgggaatccctgagaactgggcatttcagttgaaggagttataatctctttctgataagtcacatcccaagaaaagataatgagagcctggagcaaggcttccaccatttctgtggctgctgtcatgtgctagactctggtcgttttcacggcatagactcgagttcaggtactaggccattcctacaacctcacctggtgacacacagagtcccgtctcttcagaatgccctttcctttcttgtctgttattcatctgtcatgaattcttcttccaggtagaacattagtttttctgtaatgaaaacatttcttctaattctatctaaaacaaaacatttctccacttatagatgataaatttagcactttgtcactcaatatcttgtgccactctttgttcctatgtgtgagtcatgctacatcaaagaaattcaaagggaagaacatgttacacaattctattttctatagcacccagttcaaggttgaatatttattaattcactttgatctagcatataaaaactaaaaaatgattagtcacgtggagaagagggtggggctagcctgtggaaagtcacagagatacaatatactcataacaaacctgcacttgtatctcctgaatctaaaatataaaaaacatttgaaaaaatctataatgcaattctgtaaaagtagagtaataattctcttctattttttctacctagatgtacctgagtacatctcccttttgctgccttgtacagtgactcaggcagtggtgattaatccaagaggggtggtggaagaggctgtgcattcatgtagaaatgcaacaaaaccaccaagcctgtgtttggctagaaaagcttcttaggatgttctgatgcttggtcctaggagacagcacttttcccttctatactaagctaaatggctggattagcatggaaaactgaaagttagaactacaaagtacctcccttgcattctggaaatgcggaagaaagcaagctgtaatcttggcatgtgaggaatccacagtctaagtgactgacaagtgcgcatgtgaggacaaaccatgatagagatgggcacagagtgttatggactagaatagaggagttaggtaagatttcccagaggaagtcatgtgtgggatgagtttaatcaaggatgctacatgaatcattaccatcgtcaacaaaggagaagttaggaggacatatttttcattgatatttttacatggttaacagtgattggatgtgggaagtgtgtgtatgtgtgtatgtgtgtgtgtctgtgtctgtctgtgtctgcatgtatcccgagatgtcattaacattccaggttaatactcattcatgtatttattgctcagtccagcttcccctccgtggtttgtttttttttaatttctagtttttttttcttcaactgttattttaagttcagcggtacatgtgcaggatgtgcaggtttgttacataggtaaacatgtgccatggtgtcttgctgcacaaatcatcccatcacctaggtattaagcctgttagctcttcttcctaatgctctccctctcccatgccccttaccaccctgcgacagaccccagagtgtgttattcccccccaacattccatgtgttcctgtcactcagctcccacttataagtgagagcatgtggcgtttggtttcctgttcctgcattagtttgctgagaataatggcttctagctccatccatgtccctgcaaaggacatgatctcattcatttttgtggctgtacagcatttccatggtgtatatgtaccacatattccttattcaatctatcattgatgggcatttaggttgattccctgtctttgatattgtgaatagtgctgcaatgaacatatgtgtacatacatcttcatatagtataatttatattcctttgtgtacatactcagtaataggattgctgggtcaaatagtatttctgcctctaggtctttgaggaattgctccactgtcttccacaatgattgaactaatttacactcccaccaacagtgtgaaagcattcctttttgtctgcaacctcactagcatttgttgtttttttggctttttaataataaccattctgactagcatggtacctcattgaggttttgatttgcgtttctctaatgatcagtgatgctgagctttttttttcatatgttggttggccgcgtgtatgtcttcttttgagaagtgtctgttcatgtcctttgcccactttttttaatggggttgtttgtttatttcttgtaaatttgtgtaagtaccttgtagactctggatattagtcctttgttagatggatagattgcaaaattttctcccattctttaggttgtctgttcactctgatgacagtttcttttgctgtgaagatgctctttagtttaattagatcccatttgtcaatttttgtttttgttgcaattgcttttgttgatatcattataaaatctttgcccatgcctatatactgaatggtattgcctagactttcttctagggtttttatagttttgagttttacatttaagtcttttgtatgtcttgagttaatttttgtattctgtgtaaggaactggtttagtttcagttttctgcatatcgctagccagcactcccagcaccattgattaaatggggagtcctttccccattgcttatttttattaattttgtcaaatatcagatgggtgtaggtgtgcagtcttatttctgagttcttcattctgttccattgttctgtgtgtctgttcttgtacccgtaccatgctgttttggttacagtagccttgtaataatatagtttgaagccaggtagcatgatgcctccagctttgttcttttgcttaggattgtcttggctatttgggatctttttggttccatgtgaatatacaaatattttttctaattctgtgaagaatgtaaatggtagtttaatgggaaaagcattaaatctataaattactttgggtagtatgtccattttcacagtattgattcttcctatctacgagcatggaatgtttctccatttatttgtgtcctgtctgatttccttgagcagtggtttgtagttctccttgaagagttccttcatttccttgttagctgtattctttttgtagcagttttgaatgggagttcattcatgatttggctctctgcttgcctgttgtcagtgcataggaatgctagcaatttttgcacatagattttgtatcctgagactttgctgaagttgcttatcagtttaagaaacttttgggctgagatgaggaggtattctaaatataggatcatgtcatctttaaataaagataatctgacttcctctcttcctatctgaatactgtttattcctttctcttgcctaattgccctggccagaaccaataccatgttgaataagagtggtgagaaagggcatccttgccttgtactggtttttcaggagaatgctttcagcttttgcccattaagtgtgatattagctgtgggtttgttatatatggcttttattattttgatgtatgttccttcaatacctagtttactgagagttttaaacataaagggatgttgaattttattgaaggctttttctgtgtctgttgaggtaatcatgtggtttttgtctatagttctgttgatgtgaggaatcacagttattgatttgtgtacatttaactaaccttgtatcctggggatgaagccaacttgatcatggtggaaaagctttttgatgtgctgctggatttggtttgccagtattttattgaggatttttgcatcagcgttcatcaagtatattggcctgaagttttcatttttggttgtgtctctgccaggtttttgtatccggatgatgctgacctcatagaatgagttaggaagaagtcattcaattttttgagaatcattttcaattttttggaatagtttcagtagaagtggtggcagctcttctttgtacctctggtagaattcacctgtgaatctgtctagtcctgggctttttttggttggtagactatttattactgtctcaatttcaaactcattattattgatctattcagggattcagtttctttgtggttcagttttgggaggatatatgtgtccaggaatttgtctacctattctagattttctattttatgtgcgtagagatgtttatagtattctctgatggttgtctgtatttctgtggggtcagtggtgatatcatttcttatcatttctgattgtgtttatttgattcttctctcttttcttctttattagtatagctagtggtctatctattttgttaattgtctccaaaaaccagctcctggattcgtttattttttgaagggttttttgtgtttctatctccttcagttctgctttgatcttggttatttcttgtcttttccagctgtggggtttgtttgctcttgcttctctagttcttttagtcgagatgttaggttgttaacttgagatctttctagctttttgatgtgggcatttagtgctattaagttccctcttaacactgctttagctgcatcccagagattctggtacattgtttctttgttctcattagtttcaaagatcttgttgatgtctgcctaaatttcattgtttacccaagagtcattcaggagcaggttgttcaatttccatttgatggtgtggctttgagtgaatttcttgatcttgagttctaatttggttgtgctgctgtctaagagactgtttgttatgattttagttcttttgcatttgctgaggagtgttttacttctgattatgtgatcaattttaaagtgccatgtggtgatgaaaagaatgtatactctgttgtttgggggtggagagctctgtaggtatatatcaggtctgcttgatccagagctgagttcaggtcctgaatatctttgttagttttctgtctcaatgatctgtctaatattgtcagtgaggtattaaagtcttccactattattgtgtgggagtctaagtctctttttaggtctctaagcacttgctttatgaatctgggtgctcctgtattgggtgcatatatattttagtatagttagctgttcttgcttaattgaaccctttacaattatgtaatgcccttctttgtcttttgtgatctttttggtttaaagtctgttttgtcagaaactaggattgcaaccccttcttctctgatttctatttgcttggtaaattttcctccatccctttattttaagtctatgtgtgtctttgcacgtgagatgggtcttttgaagacagcatagtgatgggtcttggccatttatccagcttgcctttctgtgtcttttaattggggcattaagcccatttacatttaagattagtattgttatgggtgaatttgatcctatcatcatgatgctggctggtcattttgcagaattgtgtatgtggttgcttcatagtgtcactggtctgtgtatttcagtgtggttttttagtggctggtaacaattttttctttcaattttcagtgattctttcaggagctcttacaaggcagtcctgagggtgacaaattccctcaggatttgcttgtctgtaaaggatcttatttctctttcacttatgaagcttagtttcaccagatatgaagttctaggctggaaattattttcttcaagaacgttgaatattggcccccaatctcttctggcttatagggtttccactgagaagtccactgttagtctgatggcttttcctttgtaggtgatctggactttctctctggctgcccttaacattttttctttcatttcgattttggagaatctgaggattatgtgtcctggggttgatcttctcatggagtatcctactggagttctctgaatttcctgaatttaaatgttggcctgtcttgctaggtttgggaagttctcctggatgatatcctgaaatatgttttccaactttattccattctccccatctctttgaggtaccccaatcagtcgtaggttctgtctctttacataatcccatatttcttggaggtttcgtttgctcttttttattcttttatctctattcttttctgcctgtcttatttcagaaagatagtcttcaagctctgagattctttcccctacttgtctccatttttctcaggaggtattttaacaaaatttaaagggatgtaccacactgtttacaattactgtgtatatttgtgtttacgtgtgcacgtgtgtgtacgatgaacccaaggaaagcatattctaaaataaggaccaataatattattttctatgatttcttcttagtactgaacccaataaaggaatatcaagaatgtttcagacagtagggtaagatagagataaatcctacaattgccacttataatctgggtaactttgggaaaattacctttctttgaacttattttattaatttttagaatgagaataataaaaataccctcctcataggactgtggtgaagattaagagaattaattaatataaaacagcatggagccaagcatatggtaagaccttaaggaattttatttcattaattataaaagacacatttctcccctacattttaacatctccgtagagaaaatatgtcttacaatttatgttcttatagttgatgaagcaagtattcttatttaaatatgatttataatcgaaacatagttttttgttttaaaatgttagaaatcaacactatgaactcagataccaattctctcagtggggatagtttgcagtgaaggaaataaaatggagaaatttgcaaattaggacaaaattaatatgtgttctctttgagtttattcatatttattccacaaacatttgaatggataaccatgtgccaaattctgtgtaggacaaatttcacaagatgaataaaacgtaatatttgtcttcaaagatctaacacatgttcatggaagacaacagaaccgtataagtacagcatcagttataagtacctaagctaattgtttacatagaagaaagacctaattcataggagaggagagggtggggaaagacaaaatgaaagatgtgatttctaaattaagtctcaacagactggtaaagtgagccaggtaaaaggtgaagggaagtaagctctagaaggaggtaatacaaaaggacttgggagaagaagagagaagaatctttcttgtccaagaaactacatgatatttaatttggatgaaatatttgcagaaggagtaaaaaatctcagctagaagttaagaagggtcagctcacggaggaccttgcctagttatgctgatgagcttgaactttagcaggagttaaatgaaaatactctgaaacagtttaaaatggagggggtgatatactcacaattttatttccaaactgttgttcagagtgaattaaagtggataggatcaaagacaaagagggcagttaggcgcttattgtgatcattattaatagtggtattggagatgtagtgaaatgggcgattatgaaagtgatagaatctataggacttgatgattaatggaatgtgaaatagagagaagttaagttgtaataaccacatctcagttcaaatgataaacaaatgccatgcagatctagagcgggggccatttgcctgagccattgtgcctaacacagtgctgagtccacaataaaccaatgctaaacagttgtacattgacatatcatcgattcctctggaaattctttgagtacttcacacacagatgtccatattgaattaatacataattatcaagagaaaaaatatccctgagtcaacattctagaaatgttcaagtgtctagattggattttctcattgtccttttccataacaacacagtgacttggaacataacatgacactaagaaatagaagaataaaaaggatcttgaagcaattcccttttatcttgctttattcttaacagcatttctctggtctaattcttttatggttccagggagaattacatttcaaattccataattgcacaggagaattggagtcttgtaaaaatttagagtacttcattcaaaggcaatttttattatcaactgaacctatgctgtgatgcagccaaagaaattgtttagagcatcattaaaataacctttttaatatgactgctttctcttgaaaaaatgtagcaccctcttatttaatattaccatattacaatggactatatatttgttgaaagtcttatagtatggtatttagtatattgaaccagcacaaaatatacatgaactttatcagttttcattttccctttacaaaccaagaacaatattaaatgacattttatgacatttgataggtatttaaaatttgttattgaggttcttcagtgagccataaaatacaagtgtaacagtatggctgtgctttcattatgagaaatgcaagcaggaagcatttaaatcagcaccattttccatcaatgtcttgctcctgattctctgccaagttcattatctcttctgtccctaaatttgtccatatgaaaaattaggagaaaaaagaataaattaatacctgcctctaaaatgatctgaaatccaggtatggaaaatcttatacaagtttaaaagactggtttattcactactgtcctcatttgtttgaacacactacaatgttctgtgggatagtagctgagagacaagcaatagtccttttcacaccttccatccgtaaagacaattcttttatttgcagctgaagctattatatccagagcctatggctgtttggctcttttaacaatggaaattttaaaagagaaacagcaggtaaaatgtgaaaatgtcctctgggatattattttattactacatgtcccttatcatttagcaaactagatgcaatataaaaaattaagtcagtttgtttggtgcctggttggcaaaaaatcaaataacagttactaaagaaataatggtgagctaacctaaactctgcgtgtgtgtgtgcgcgcgtgccataaagccaaggtggagaggtgaatgaaaaagtcattagaggagaggcaaaagccatatcgcttgaaaaaagcaccatggtatcatggtcgaagaatgggctttagacgctggcaagcttgggtttcaattatggcattttgcagtgtgctatttatttccgagcattaatttctacaatgaaaaaatacataattaatatctcataggatttgaaggatcaagtgagatgactgaaataaagtatgaatccagatgtctgtcatattaattctctcttttaatcatgggagctattgacaatgcaaaaggtactcagtatagcactagaatgatagtgtacctcccgagataatgtgtaaggtccttcactaacacctttttcataggaatattgttgagctgccttcacacagatagaatatctgggttacaaccactttgcagaaaagttaccagatatagctttttgaaattttctgcctgggttaaaattacagtcttgtagtaactctttggtgcatattagtaactgctgaactgtgtggtgttgagccaatcacattgatgggaaaggaaatttaatgcatcagacaagggaaagttaccacggttagttagtagacatagaatgctctaagttagtaaattcatggtaagttatgcaatagaagagatcataaataactaaataacagggaaactgcaaaaagactagcagaagttggctgggcacagtggctcatgtctgtaatcccagcactttgggaggccgaggagggtggatcatgaggtcagcaattcaagaacagcctgtccaacatgatgaaaccccgtctctaccaaaaatataataaattagccaggcatggtggcaggcacttgtaatcccagctacttgagaggctaaggcaggagaattgcttgaacccaggaggcagaggttgcagtgagctgagatcgcgcaactgcactccagcctaggcaacagagtgagactctgtctcaaaaaaaaaaaaaaaaaaagactagcagaagcacatcagttattattattctgtaggaggttcaaccagaatctatctctttgctctctattatctataagtcaccttctagatcttacaacaggggcagaagtacacctctctgaaatatccttcttacaactgtaacttatagatttggtttggtgtctacattgccaacattacttaaatgtttacaattccactgtgacctgttgtcactattacatttcagagatgtataaaagaaatgtcctcttctatgcaggaatatttgtatttcatgttggaattaaaacccaggcatgttttagtgtacagataggtacccttctaaaatattaaatcattaccccacagcatgaattaacctttgtgcctctgctcttataacatcattaacataatcatgataggatataaaacactcatagttaccctcacccctgctcttggctctctctgagggaagccagcttccatatcataaaaagaggcccataaggaaaaaaaatggaggcctcttgcctggagctaggagaattagctgtctgggaagtggatgtttcagtgtcagtaaagccttcagctgactgctgccccatctgccatcttgactgcaacctcatgagagaccacgagccagaacaatcccagccaagactccccagggtgcctcacctcagaaattgtgtgagataaatttgtcatttttagctattaacttttaacattatctgttatgcagcaataaataatcaatacaggagggtcaaggggtcaagtgtttcttgttgatacccagaacacgtgagatcagggagtaagtaacagaccttctagaacaagggttgattaaatctaagtcaggagaacaaggctcaatcagtcaagggatcttggaaagcaagtgaaagtttggagagttgagaacaaggcccttagaagtgactcatggtgtgaataaattccagagagcaagagcaactgcctgcctggcttcttgcattttcacagcttgcatttggaaaggggggcttggtgcattcaaatgaataaaaacaagatggtcataacatattatgaatactgtctgtatagtcaggcacctttcccaaagtaataatttgaaataaagattccattggtcagtaacaggcaattcccatttttgagtgctttcgtgatgtgttcaatattcccagttattacttcccaggcattatgctttatagaaaagtacctattttttaatgactggataagctgggccttacaatccacttcaaacctgttgttctatttgtccatgagtacacaggctgctctaggcaggaggacatgaaactacaaaccattaaatggtgataatctaaaaaacgttaagtaattgtcttgcagacgtaaactcagaataacatgctatatacatcttggaggtaccatgaaggcatggcccaagctgtatatatgtatgcgtttgtataaatatacatatgcatgcaatcatatatacatatgcgtgtgtgtgtgtgtgtgttgagagaaagagaaaggagagatacctagcacaagaacatattttgataatttaattcacagacataaaaaggaaatgtgggcacttaagagactttcacttgaacgatatcgctccacagtgaggcctttggggaaatctctgcacacactgcaaacactgttatggtagaaggaagctttcttctccctgttactattagagagtttgtcacctatctttgaggctcttggcccatatctaagtatgaggaaagaaaccttagcagtctttgataggcagaggataacattgtaaaccctagagctgtgttttaagaggaagttagaacaccagtaagaggaaggtttacatgttaagacaaacagatgaaccagctgagtaaatgtgggacttgaaggtttcccaatactctccagctccaagaagaatggacttaattaactgagagctgagaccacacagtgtgggaagagcagaggaaccagaaggggcaaggtcaagggagtgaatggaaaggagagatgctgctggactctgttgaacaaatgggagagtatgtgtctatttttgtaatctattagttacgatactcttagatacaacaaggaaagtcaaattcgggtttgttgaaagacataggaactttactggctaccgtgaaaggagagccccgtggtagatggacattaaggctgtactgattctgtggctcaaaagtatcactaagagccatattcattttcgtgtctttgtcctgctcctgcctgctatggaaccagcttaatcctaaagcctggatccccatcagagtcacagaatacaaagcatttgtatgttgtatggaggaggagtaactgttcaaataaaaactggggaagtctccaggcaggggggaaagcaactgtttttgttggagaatcaatcacctccccacaccaccctccaccttctcctgcccctgtcccaatggctgtatcatcctatggagataccatctgcatatccaatagacagagtaaaacaaacaaactcctaggtgtagattacttcccacctttccaggtattaaaggtattttatagaaatatgtgtgtatgtatattttcctgaaagagagtaaaaatatttgtcaggaattgaaagaaatcggtgatcctaaaatgtcaaaaatcacaaaattttaggtaaagtttcaagataaattggttcttacttctcttctattgtttccccaatttacatccacatcacaaacacaagaacaactcaaaccttttccttttgtcatcctacaccatgtcatgcctcgggttatttgaccacgtcacttcctctgcctcttctgcctggtaagccttaactctgcctttatgacggaattcatgtacagcctcttcactggagcttttctttattgctttctctttgtgaacagcagatccagctcttttgtaccataaacgtcccctaacaataagcacatactccacaacattggtactttttgtttgcctgtcctactccctaatgagactgtgaggaatttacacacaggatttgtgcctttcctattcgtcttttggtgagctgtgctggcttatgaagctgttgttcagtgaacacacaaccattgataggtgtgattttcagcaaagtgacaatagagaacgtgtaggagctttgtgatggtgtactagtatcattgttattattattattattcaatttaagagaggtttttctccttggttaggacctgaaaacctacagggcaatatgataaaaataaatctctagataaatgatgtgatcttctttaatcttggggattcacacatcatggccctgaagcaagctagtgaatgtaattcttaagtgctaacatttgtggagtgctttctatatgccaggtgccatgcttaatgctccacattcatcattccatttgatctttacaaaaatctcaggagatgggttccattattattggtcccattttatagatgagaatgctaggatttgcagagagtatgtacatcatccatgtcacactatctgttcattagatgaggcaggatttgaattcagggccctctagctataattaagcccttcagaccagttaaagattatgctttaaggtgctctgtgtgcaaggcaaagcgctatataatttattataaaatattctttaactcttaaccataatcttgcaaggtagaaattattgctctcattttaaaggtggggaaactgagttttaaagaagataactacatttgcctaaaaagtataatcagtaatgttagtgccaccctttgacagaagtttatttaattcctgaattcatgtacctttcaatcgaaacccaggaaaaacgagtgccaactacatccaaggaattgttgatgggaatggggggtgggcagtccaggaaagctgaggctgttatgagaaaatgtctctgccttgtggggacttataacactgtcaagatggtaaaatctggtattataaaacaggaatagcatttgaggtcatctatgaaaataatgtgaaaagctagctacaaatgaaaaatttaaataacaaatcagcgcaagcctagagagatacctctggatagaaggtgattaattctctagtaaattagatgaataattattgatatagccactagaggaagggggatttgggctccaaatttactcactgtctttgaagaagctggtcctctgagcatctgtaagttacctcactgcagtgtaatgtgattgtcaatgtatttatagatcaaccacattagactgtaagttacatgagggaaggtggggccatgtattgtatttttgttctcagaatttgacctaatttgttgtacttagtaggtattcagtacaaatatattgcatgagtctaccatcacttcaaccaggggggcatggtcagaagaaccatcatacaggaagcaagttttgaagtgaggaaattttttttttttgacagtttaagatggtatgggaagtccctttaggtggatgaaatggtgtgagccacttgatgttgttgggagagcatcacagtgggcgatctctattcctagcatctgcctggtccactggtagtgggtggccattgctctctggaaatggacctgcagagagggcacaggcaccaggagatatcagagtggcattatataatttaagatatttagccttgatcttgaaagatcacatgctgccctgttacctcgtatacttggctccttctccctggtccatgaggccatttgaagacacttaaaatgcctatttcattcctcactgcacctatggctttatattgccttgtcatattcaacgctgatgctgtggtctgcacacgtataagtcacaaggatgccttctggcatttatcaggcacaggtttcttggatccatcctggattctgcctctttcctaagaacagagtatggctctgaaatggatgctaacctcagaccaaccagctgagtggatggaaaggagccaaaggaaaaccccagaagatagtccagaaagaagatggaggctcttatgtctgtgttgttcacatcaaaatcttcactttctttgtaccttgaacaatttggagtccactttatcttgaacctacatccaaatacctctgtattagggtgagcagggtgggaagaaggggaggggatatacattggcagagagatgatcttctcctggaggttgtagtgtgtcaccaagaaagtcattgcattgccggtgagattcaaataattaaagtatatgtgaaatcactttcaaaaaattctatatggaaagttatatgttgtaattaaatggttttattgacatagagttttacattaacgaagcattctttttcaaaaaaaataatatatctaaatctttttctcagttaagaactatgcttcttgttctggggaaaacaaaccacttttatttacaggagaaacaaatatactttttaaaaatccagaaaattgtaaataggctagcagagctgctaaacacgcataagatcacaattgtgattttacaatacatcttaataaaaagagtaaattacttttcattttcacagacataagtttgtttttaggctttcccaagtggattgatacacttgtttgaatgtgatttccatttacctttatattaaaataaatggaagtgaaaaggtcaagtttattcagaaaattgttagctatccttgggaaaaactaattcagcatgtgtgattttaatcaattttcattcattgttaaagttcacacaaagtttagcttgatgtccataggaaatggaagtggtgactggtatatcaggcacgataagtataccaaatctgaagtcctctagatagtatggttaataaagcatatttgtctggttccataaaatagaaatgttgaaactagaagagctgctgggttaataggagcattttcaattctcaatcttcattattctcaatgccaagagggaaaatttgactcaaacacactgtttgggctgtaaatcagagtagttacagggtgacttgggaccagctatgaaagaaagaacccagaagtgggtgatatgaggaaatatatgccccaaagaagggatttgggcctttttcctactgcctcccacagagccgggctgtaccacatgcttttccaaattttcatttagctccctttatgtgctagggatcatcagggcaacagggcaaggctggatgatgttatggtgttataaaggttaggaataaggcaatgctcagaatgatgtatttcagaaaggactacatgcccataaatgcaatctagataaagatgggattaggcactgaagctgtaattgtgctggtgatagacatgccagcaatagcagtggtgttggtgatagacaatcaaagatggaaaggatccgtgtggcctgaaataagatagattggggagaaggaaggtcttagtctgatagtgaagtaaggagagggattgaacaggctgattgaatgatcattccaggcctcagtagggatgcagagatagggacgctatgtgatagatgtgtgtagatactagcctattctgctacagccagtaggaatgttatgttttgacatatttgattgacagatgcaagttgtaccagactacacaaaccaaatagttaatagttatctcaaaagaggatgttgacagatttcaaccatttgcagggtcattatggcccaacctttggaaaattaccattggtatccctcaataatattattttgcaatttggtttttaaacactctctctcccttttaggtaagtgtgtacaggtgcatatgatagatttcaaatgtgaagtatacctacagggtgagaaatgtaatggacaaaatggggggttatggactgaattgtatcccctgaataatttatatgttgaagctctaacctctgatatgattgaatttggagatagggtctttaaggaggtaattaaggttaaatgaggctatagtggtggaatcctaactctatagactggtgtccttataagaaaaggaagagagagtgcacatctataggaaagactatctgaggacacagtgagaaggtagccatctacaagccaatgagggagcccctccccaaaaccaaccctgccaatgccttgctcttggacttccagcctccagaatcttgaaaaatgtaatttatgctgtttaagtcacccagtatatggtattatgttatggtagcctgagcagactagaacaaggggccatggtcaaatagtaattctacaatggaagaaaattgaaagccacattgagctggacctcttcatagacccaactggagagccatgactttgtcaagagaatggagaaaattcttatcctaatatgacataatcttttagcccagtaccttttaaatagccttgttatactggatgtactataaatttatcttaaatttatcacttttgggggaggatgttctaaactacattttttcataagtttatgagaacaaaaggagtagaatatgtagataagtatatattcataagatgtatattatgtatatatacataagaatatgtatgtgtatatatttgttccatcttaacttttccataaagaatttataactcacatctgtcttaatttactttccttgatcaccgtgtctattagttgccaaaaggaaatggaaaacaccaatatatcttgttatgtttatactgagaatattctgtcaaattggttggaaaaaaactagaaaatacaaagtcctacagtatcaaggatttaataactattgaatgtataaatgataaaaataaaaagagaccatgaggacaaaaaagggagaggagagtataccagctaggatgctatcagtggcaagtaataaaatatccagtataagcagacttaaataatataaggctatattgccctaattaccaagaagattgaaactatgcttcaggtgtgggttgatcatggtggcaattccttatctatattatttgcccaggtccatgtatcagcttcatcctaaggctggcttctctcatggtagcaaagtagctctatttgttccaagggttcatatgaatattccacactgacaggaggagagagtgtcattgtttagtaggtttatggagttaactatgctgcccccatgggccatttttctactttatgcagactagccttctaaagaacctagcatatttgaggagtaacttaaattacagtgcaagttctaagtcagtgaaagagctgcctggccatatcttttgattccaaagttctgtaggacagaaccagcacattttacaaattggtttagaattatacaagcctgtctggtgtattatggggagaggtgtccctgatggggcctaactggaaagagagacaataagatcttgtattggcacccaagttgctgaaataaatgaccaaaaccttgattgtttaaaataacagtaatttacgctttcacagttctggaagccagaattcaaaaataaaggtgtgaacagggttggtttcttctgaagactctaaaggagaatatattccatgcctctatcttagcttatgggtgattttggtaacacttggcattttttgacttgcagacacatccctgcaatttctgccttcatcttcacatggcctttccctctaggtctctgtcttcttttatatctcttataagaacatttcactggatttaaagcccattctaaatctagaaccacatcaccttgtgatcgttaacctaattatatctgcaaagaccctattgcaaagtaatctcacattcacaggtattgaggggttaggaattggatctatcttctagtatccactgttcaacccactacagatctcttggagaaaattagcatgagtgaaggtccaggcagtggaggagcagagtttctaggcacatcttaattctggcaaaaagaagagtgtcatttaaagcagcattctcccaaggagggggatgtgaaaatatgttggaacttctctttataattttcttcatctaaggaaataagaaataaataatttttctaatattgggcatatagatggataccatggccctccctgggtctgtgggtcatgcaggtacatgtcaggtacaagaggcatcctgactttgggagggggatgccacacagatgtggggctgaccgtcacacgctttttcatccttttgttttctgtgtttcaggatccattgctgtttacatgggcccattaaatggagttatgactattttctagtttatgtaagttgaccttcacaagacgaacaattacctttaaatattgtttctgactaaagacaatactaagaatgcattagtaatagagaaaaaataggaagagctgacacttctacacttaagtggactcttatcagcccaagtaggaggtaaaattatggtaatctaatcagatataagaagcatttagataaccaaatttcaaattattagacagctaatatttgtattatgaatttatatccactgttgttagttgttaccatcactaaagtccatgatatgtatcgagacagtagttattaaaagtacatatttggggaatgtgaacttaaacatattttattaatggagcaaaatttttaaactttggaggccattggtttcatggaaataaccgtgcatcacttggggctcaatagctttacttgaaaatcccactaaaaagtgagtcatgagagtcttgctagccctttgggtgacaagagaacagaaccataggttagcaatgcaaggtaggtcagaaattaggtgcccagcttaatttctgttctgcttagctgctgtctgttctgctatccaatgccaatcaagtagagcaatggccagagtagtggagcgacagattctacttatatgtgataattcaccatctccagcctcttaagcagaattctatgcaccagtgtcagttatggaaaggggaacactgtatacaaatttccaatcccagggggactctaaaacctcaccagtttctacaaaggtttctaagtgtggaaggaggtttttcacaaacccagctgccagaattctacaagagttcttgactctggcagggactcaaaggagacacggctgcttcaggggtcatacctctactacttgcattcttagctccagtttggtaagaaagaataatgataggagtcaggcaaagcaactttattattcaaggataggcagctaaaacaaacaaacctagaatccatgctgagtcagttccccgagtctcaggaaagttgcccagggcaggtggagccttatctgttcatgcccacttcatactgcagctgagggacaccaaaagcaatccactatgggttttacaccctggttgcccctgggttgctgagcacaagcattgcaggatatcctgttccaggagggatgacaaagcctgggctattctaggtggtttctccttatgtcaggacactgtatcctcagcacatgctacagttttcccaaaaactacagcagaagggggaagaactgggtcagccaaggctctctggggccctgtcttcctgcacacattcttcccctgttcccaccaccggcacttactaattgacactatagacagaaaactgagcaccttggtctggaaggagacagtgctccagaggaatgttttgtagtttggttgcaactgtggctcaggtgtacatcactgtggtaaaaaaaaggaggaaagaaaagcaagaaaacagaaaaggaagaacgtgaagctaatgttgggtgtcagaaaagtcctaacagcattcctttaactcgtttacttttgtttgtttttgttttttgttttttgttttttttgagatggagtctcactctgttgcccaggctagagtacagtggcacaatcttggctcattgcaacctctgactcctgggttcaagcgattctccggcctcagccttctgaacagctgggactacaggcacactccaccttacccagctaattttgtattttttagtagagacagtgtttcactatgtaaaccaggctgatctcgaactcctggcctcaagggacccacccgcctctgcctcccaaagtgctgggatttcaggcttgagccacagcgcccagccccattgcttactctttcactgctctacctcttatcacaagaagctggcccttcaagccaagccaattcccaggctcctatgtcagctgcttgcatttgaccaaagggaggcattggcaggagattggagggaagaaagacaggaggagcctgggtactttcttcccctctctgagtcttaggtggcagctacagtgctacatctcttccgtgatctacctattgacatccaggttcattttgatttcattggcctctttcctctctctctccagcctaggtgtggaagcagccttctgctatttctgatctctaagtgacttccctgactcatttttggcttgtcaacttcttaattccctgtgtaaaaaatgcccttaaatttcctttatttcaatacaataactaatttctgttttcctggttggacaccaacatatcctttaaggtagaagtagataggtgatcatcattcaaattttatattttattacttaattgcatggtgttttccatttgcctatgattttattttttagctaagatatgttctataccttttcccctttgccttatgaaactgccaagaactaatttcatttttgatgtcctgaagggatattattagaaaagggatggagctgattgataaagcaaaaatacaaatttataattggtgaattgcagatcgatctatatgatgggaatacgttctaataagatttttttctctcatttcctccttgcagatggatccctgaaagcctattatctttaatataaaattcttatttattatcttttaaaggtttggaaggatgagagctttaaggggaaattgagtagagaatgagattaggaaaggatttcatgcagagaaagaaagatatataatgcaaactatgctatggtctttgcatatgcaaacaaagcatctgacctactttcaggaggccacactcttttgagcttttccagtaattcattctctcttcccaccaactctaccctgttagaatgcaaatagttaggactgtaatgtggggcatggtatagaatagatgttgacaaactactaaggcctgtgggccaaatctagctcacagtctgtttttgtaaataaagtttcattagcacatacctatgcttaattcaagtgcttattttctacagcttcttacatgccacaaaggcggatttgagtagttgcaatagagacaatgaacctgcaatgttgaaggtatttgctatgtagatctttatgaaaaactttgctaatccctgctatacaataagttgcttgcttttaagaggattactatgatctttttgcttttcaggtgaaacatttctggagcacctactgtgtgctaagtactggctagatgctttatagaataaaagcacaggccgggcatagtggctcatgcctgtaatcccagcaatctgggaggccaaggtgggtggatcacttgaggtcaggaatttgagaccagcctggccaacatggcaaaaccccacctctactaaaaatacaaaaattagctgggtgtggtagcacatgcctgtagtcccagctacttgggaggctgagacaggagaatcccatgaacccaggagacggaggttgcagacagttgagatcatgacactgcactccagcctgggcaacagagcaagactccgtctaaaaaaataaaaaaaattaaaagcacagatatgaaatgcaattaaatttttcatgtagtaggataagaatgacacctgcaaatttaggttagacaagggaataacatggatgcttagaagatacagacaagggttgttccagatgacaaagaaactgctttcgactaagatagagaacacaacagcaggggttaggattttactttcttttcaaaccaggaaagacaagagaatgccatcctcctgtgtgtatggagaaaacaaaagctgaacacagttatttgtgctttaagttcagcctgttggacttcatacactttcaaggaaagcagggcaagaaaaaaaaagattaaggtcaggaaaaaggcagtttttggatgatcatcaattcatttacccatttacccatcaacgtttgagtgccctttcttccaggcatggtatgacatgctgggcatagacaataattgtagcagaggaggttcctgcccccagaaaacttttattctggtgggtggcacagggtgaatagatataatacatacttccagctcagcagactaacaaggatttttatctcagaagaagatttaggaggatctttaaataaaagtgcaaggagaatgtgttgaagattcaggggagtggagagtttgagaaaatgggttcaggatccagctgcctgggttacaatgggtggccctttagggtgtacagctcccctttttgggaagttactgagtacctctgtgtttcaggttcctcatctttaaactgggatgataatagaatgtactcataagactgttgtaagcattaaatgaggccatgtctgcaaaatgcttaaagtagtcagtgcttggcacatagtaggagctatgatgtttactaatagaagaaccaacctgaccctttgtttttactctgagactgtccacgttttaattattttttttttgtgatagttccaataggataagtgaacaagtctaagaagagagaactgttttgttcttttttatattttaaatgaaagtacttgagggtcataaaatgaagctagcaagaagttataatttaattagcatgccattgtttatctacttcatctggaataattaacttcatgtatacaagactgctgcttccaaagatctcaaaatattttctttgaaaaatgcaattttccactgaaatatgtagaatagaaagtcaaattataataattatcatcatcaaatatttatcaaatggttatgatataccagtcacagaaagtggtcttacacattctggctgggcacggtggctcacaactgtaatcccagcactatgggaggccaaggtgggcggatcacctgaggtcaggagttcgataacagcctagccaacatggtgaaaccctgtctctactaaaactacaaaaatcagctgggcgtgatggtgcatgcctgtaatcccagctactcgggaggccaaggcatgagaattgcttgaactcaggagatggaggttgcagtgagccgagatcatgccactgcactccagcctgggcgacacagtgagactgtgtctcaaaaaaataaaataaaataaagtagtcttatatattcattaactcttttccttaattttggaaatccataaagctgatattttatccccatttttcaaatgagaaagctcagatgggcaaatagctcagattctattcctaaatcacactagacatgaggtaggactccttcccagggctacctgactccaaagtgtgtggtccttcctctttcttatgtgatatggtctcaaggacacattgaaagttgacatttagaacacctacttcatcttctttcaaaaagaaagcattagtaggcaaaattgtaaaatgtatccatcattttatcaatcataaaagcattacatatttattacagaaattttgaaaagtttagaatactatgaaatagatatacatcagccattaccctagccactagaaatatccattttaattattttatatattttcaaaatttctttttatacaaacacatacacttctaaatggtttcctactacattatatggtaagtcagacttcaaatttaacatgccatttagagttgtataatattatttcaaagtctacatagaatatttgtatggctgtagtacaataacacttaagcagataccttgagtgcttctaagtttttacaattataaataattttgtaaccaaattctttttttttttttttttgagttttgctcttgttacccaggctggagtgcaatggtgtgatctcagctcactgcaacctctgcctcctgggttcaagcgattctcctgcctcagcctcctgagtagctgggattaccggtgtccaccaccacgcctggctaattttttgtatttttagtagagatggggtttcaccaggttggtcaggctggtttcaaacttctgacctcaggttatccaaccccttcagcttcccaaagtgctgggattacaggcgtgagccaccgtaccccgcctaattttgtaataaaattctgacgcagtctttcagtcttttattatttccttaaaataaaatgactgggttaaagggtaaaattattttagaattgctgatatgtatagacagactgttctccagaaagaatacaactaagtcaatgtcaacttagctaaagccctatcggaaaataaaaacatcgatatactttcctcacttaaccattaggcaccttactaattttcaggttatatttggcactgaactgaacaatacaaaaatactttgagcagtatgtcactcaccttctaactttcaatgatatatgatccaagataaaatcattcaatctatgattcccacactcaagaaatgtttgcttgcccatcattttcaaaaagaaaaataataaggatgggtgctaaaagtacaaatttggctgggcgcagtggctcatgcctgtaatcccaacccttagggaggcagaggtgggcggatcacctgaggagtttgagaccagcctggccaacatggtgaacccttgtctctactaataatacaaaaatagccgggcgtggtagcacatgcctgtaatcccaggtcctcgggaagctgaggtatgagaatctcttgaactcaggaggcggaggttgcagtgagccgagatcgcaccattgcactccagcctgggctgcagagagaatccgtctcaaaaaaaaaaaagaaaaaaataaaataataaataaataataaaagtaaaaattttagactttgcatgtgttcctgagtggatttgtgtttgtgtgtgtgtgtgtgtgtgtgtgtgtgtgtgtgtttgcgcgtgcgtgcgctcatgagtgtgtctgtgtgtgttggggaaggttgaggtgtagtgatgtggagtattctcgggagtttcctaaagtcatgaaatctatgaacatgacaagcatgctgggtataaaggcatctccagcaacatagtggcagccaaagttttttataggaaaaataatctgcttcccaaaaagtagaaattaatttcaaagcaacattttataattctacactttattaaattaatacttataccttggaaatagataatcaagttctgaaccatgtagcactgaaacactagtgagagctgatgatgacagaggagggcctttgccttctgtgacaacaaaagcaggaacaaagagaagcagacaaaagagtgagtgattcagtcacactgatggctctaaacggagaaaagcctaaacaacactcttaggaaggaaatgaggatgagctttcttggcccaaaaacctggtctggctccttgaaagttcttgaaccaagttctagtttctgaaaagctcatggcatatttagggtttggttatttttctgagactatttgtaaggttctctctgggtttctttgagacctagattatgttaaatctccattacttgacacaatccgagtaagtctatgattgttttttttgttataaaaataaactaatacagcaaaatgatttctgagggttctgaagtatcagacttttccacatcatgtgatattagatcattaggaagactggacaaataaacaaagaaagaaacaaaagaacagccactgagaatgaaaaagagaaaaacattgatcctgtttcataatggggttgctgtctccctagaaagacaaaagtcgcttgaaagaatccttttcaagttaaaatcatgagtgtattaatattatgtcacatttcctagtctctacctatctgagctcctgagaaccatatagagatttgacagcagaaacaaaaaattacaggaccataaatctttctgttatctgtgagcaggaaacaggctctatgaaaggatgacaagaggccctgatcccacttgaaattaagacagtaattaagcaccaaaataaaggtaacaattgagaagaaaatgtcctctagtggaaaattctcattaattcaatttgtattgatataaataatgttcctcaactttcttttgaatgatatatagtcttttaatggccaggttgtcagtggaaggaaaactaatactttattcgttgaagaggttcaaataagcaaggatcatcctccatggttgaaaatgaaaaaaaatcaatattgatgtgtttaagacactcttttccacagttgttgaaataactttgaatgtctcataaaagacaaatattttattctaggaaaaaattctaagaccttttactacaaataatctgaaaaatattaagcctaggtaccactatctgcctactgaacctccctgaaataaaaaaaaagtacatgttgaaaatgaaaatttattattagaataaagctactgttaatcagaatgcagctaatcagaatttttagttaatttaagaaattagtttgttccagtacaaaaaagctgggtacacagtcacacagagacacacacatccagacatcacctcccacacacaaaaagatatggctggtatattgattaatggatgactattaatatataactaaatatttatatgtatcactaaataatatacaaaatgaatcaaagtactttgtcttatgatatgatcaaggacataataaatatgagcgagtgagcaaaattaaaaaacaactcaagatgctaccagattaccaaataagtggtgtcaatacctggtttttatactggacttgaaacacatcaaaaatagtgtgctaatattagcaaaatttctaaaggaaatgattgtcttttttttaaaaaaaaaacaaacgcacttaagacttttagaaaatcagtcaatcagctggcctcccaaatatttaggaaaataaatttaaagtgaagacatgaatgctaggaaatataagaaagaaaatttaaaaggaaaaaataagaaattttaaaaaatgaaataaattagtattacagctagcctgcttaaaattgcataccgaaatgtttgatataaagactaagtttttggtcatgtatgacttggtgaaagtttaatgcctttaatataaacagcaaacactattccatgtgaagacgtgaactaaaacacatcctgtgtcaaccacatattgggttgtctctttcttagtcttccacatctaaacccgaaaacaataatgtaataccctatagcatctttttttatccaatagaactttatccatataccaaactgtacacaggaaactgggcttcgtaaaatactttatgtaggacaagaaggaaagtagaccacaactcagttatatagcagtttcacctaattgggcagtccttctttgggtgttctaagcaacatcttgctgtatacaaacaaaactacaatcttgattatgttcttaactggttgatcttccttgttcaaaagataaagtagataatttgtaagatctctaaaaaccatagtattttagaagtgtaaggttgatcttccctgttcaaaagagaatgggttaaagtggatagtttataaagtctctaaaaatcatagtattttagaagtgtaaggatccactatttgaggaagggtaaccagttattagcatcattaactccattttatacttgacccaatatattgaagacagttgcctacaatggcacaactatcacatttcttcaaatataagacgtacacagctttaaaacaaagaaacaaaactgccacttgaggagtggagaagactcgttacagagccagtgctgcctgtgcctttggaagtaagccttgcacagagggttcattcaatcatcaacgcagttaattttcctggcagaaccacagttatatcttaacttaaaattgtaatggaaatgtacattcccgttaagatttcttcaaaaacttccattaggagacgactttgcaataaaaggtgactgcatatggagaagacagcatgccacatgccagggaaaacaaaggccatagaaagtgtcagatccttcagagtaggtctgcgaattctcagagactgttttgtgattgatctatgtgtcacaaaagactctcacttagacacagagcatctacttgtcaaaagcattttgctgctataccagaaaagctatttaacttaatttttagaaatatatcattaaatcaaagaaagacaaatgaaagtaaaaattttaccaactaggaaatgaagaggaaaccctgaaattgttcaatacaacattacttttaaagcagttgaaaaggtaaagatttataatttaggagactcaaaaacagattggctccgtaaacctttaaaaataatgtataaggtttgctagattatattcttggagaatttttagatacttgatgttgctacagaaaataaaaatagtagccatgtaatgaatgccataatcagctaaagaaacacccagtacctccccaccagtacctcccttctactgatgctattattaaattgatggtgagttttacataaaatagtaatttaggattagagaaaacagtacttgatgataaagctggaactagaaattcagggcttcaaatttcacatccagtgaactgctaaagacttttataactactctgtatttacaaagaatcttatatacatatctcacacttctgatgagacatattgtaagaaactattgctattttttaacaaacttttgatatttgcttagttgtatttattactattctgatacatagaactagaattggagaaattatctctttctatgtttctggaaaggcttgtaccatctcagaatagtttgttatctaaaataataacaaaaaaaaaacagggactccatagttcaacataaaaatgaaagttagtggttttcaaatattacatctctctataatagctatcattaccttttgatttccctttgtcatttgtgtaatatatatctccagtcctatagccttcaatatgatagcaactagccatatgtggctgtataaatttaaataattgaaagtaaaaatttaattctagctgaggcaggagaatcgcttgatcctgggaggcggaggttgcagtgagctgagatcaccccactgcactccagcctgggcgagagtgagagactctgtttgaaaaaaaaaaaaaaaaaaaaaaaaattagttcctcagttgtgctagctgcactttcagtccctagtagtcacatgtggctagaggctattgtattggatagatatagattgtttccatcatcacagatagttagttctatggtactcttttatgacataagaaccaatgtttttggtcacaggtaacttggtaagagaagtttgacacctttagtagcagtaaacagtgccacagtttcgttaaacaaatctgttcaaggattcttggatgctatttaaaatgaatgttaaggaaaatgaccagcctcaggttgtaatcagtagatgtagatacatgtatgctaaatttgtaaggtgagctagtcatagaattgtatagctgtaaagaccctaggaggtaccataattcaactcgtcttattttatggttgtggaaactgaggtgcagagaggctaagtgttctttgtaatgtcacaggggattttgtgacaataatcatcagcattggtagtgacacacattctcaaatgttgaaataaagaaaacaaaattaattcttgcactgaaaccatgcagtgttcccatctgagcagatcaagcctggcttatatgcctcaaagagaccaaattcaaagttctagtctgagattggttgatgtattattttcatttggttgttcttactattcccatgtttgcctgattcaactaggaatatcctgtaaatgtgccataaaatacttgacttagctttagcaaaacatttgacttttgtgaggtttcaatttagctacacctgtggctggttgagggctgagcatctacagagtacaagattgttaaatctagtaagttccagcctaggcattccttcttcatttttcctcatttggcttgctactgaggtgtcaggaaattgtacactcaagtctcaccttgacatttagtagcattgtcacctggcacaagatgcgacatatccattgcaacctgcccacccacccccatttctgtggtaagttgctctgcccttgcttctgcaggagtagtgttcatgtccgctgcttctccaccttctctaaccaggacgaaagtggtttgcatgcaggtagatgcttgatccacagacagctgatccataagtgggcctttaacatagggcatacatggcctggttcacaagaatgagccaggtaaacagtattttgaaatttgcaactaagatgttgtagggaccaatttcccctttgtcttttgaagggtcactgaaaatcaaatgacaaaaggcatattaataggagaaaagacatataagtttgataatgtgaatgggaagaaaaatcacagagtgattatcccaccacacaatggggtataaatggctatatattcttcttcttagggaaaggagatgaagaagtgaagatcatttaaaggggttagcaaatgatttttaggagcattcaatagcaatggacttgaagaacatacagtggcctgggataaaatctattgggcctgcagagcagacaactgtttgtgacaaaagtctgtcaggtgtgttgacagacttcagtctttcttcctgcgatttgagtttggttaatgaaaactcagaggaggaacccagagtaattgtggggttttttgttgtttgttttgttttgttttgtttttggtaggttcagactttacacagataagggaacttcggagaacagcttcattcagtgctttaggagagacagaggattgagagacaggaggtggggaagatcagagagaacttgcgaaaattctgaaaattttgaatgaggcccagttccagtttgtcagaagtttggctttctgacgactttctattgagcttgcatgagcactaggtctctttaatatatttttgtctttttagttaaataacttattttctgtaatttgcaaattaaacatacatactgaaacaagagctagtagtgacagtcttaatagtttactgccacggttgaaggataaaataaagatatcatcccccagaaatctgtcaattcttcttaaggtcttcagttatatttggaaagaatgaagctaaataaaacacattttcctaaaattattggaaacaaaaaaatagagttaagataaatatttgagttttctgaaatgctcaatttgtcttctacaatttccaccacacatttaaaaaaatgctcagagaacatgagcctgtggaaagaacaattgtctaagtaccaggaaacctgggtgttagatccacttctgtagtagaaatgactagtgctcacccatatctggttctcctctactttctggacacatgaaatatacatttcttggacccttaataaggaccctattacacttctggctggtagactgtgagcagaacttatacatgtcatttttgagctgcagctataactggcctggcaacccattcacattctccacctatcacagtgattctgaaaggtacaggtagagatgatgaagctgcaagatggagaatgcaaagctgtataaagtcatgtcttggaaaagagctgccctagaaaactacccaaattgcagcagactttgcattaacaagaaacacttttgagggctaagcccctgtgtattacagtttatacgttacacagcataacctatcccaccctgacgaggtagacttccagtgcctagataaagaagtcactgcttttccctatgctctgacttcttcaagcatctaaatgaagaaattggacttcattgcctccagtgactcttttagggtgtgcattcattctatcattcttctctgatgcctgccctacttactttgcagatttgctgagagggtgctttgaaacacccattgcatgggccttcccattgcatccttataaacaaaagattttgtcaaagttgaccgcttccaaaagagatcttgctatttctgaattaagcatttggagtgacgtcaattttaatttttaatttggctatgtgcaaatctttatcctttttggtgggaaaatttgaatagacttttctctttgttttgccagtattcaaaagcacaattttgagagtgcaaagaagcataactgacttagcaagtctgttagctctgctctcattcttcttgacctgcttctcttcatcacccaattgtgaatcttacctcttggtccttagctactatcctgattctacagatcagccctgcccaaaagtgcctgctgatagtcactgccatgacttgtaggcatgcttctgtaataatgtacacatatggtcttgacaggaaagaatctgctagatccttcacactcagtatcacatgattccagatacagactaaagatcaaaatattaccttggaaatcacaggttagaaaataatagctggttggtgagaatatttaatggtttgcatccagacaacttgagactctagttctgaatctgccacttcctatctgggcgacttttggcaagttacttaattctgtaaacttcagctctcttctttgtagtatgagttaacagcaagtacattatagtgtagttgagaaaataaaataagacagcttatgtaaaggacccagaataatgcttagctccataactagctacaaatgccagttttttcatttatcttatatgagggaggtaagggaagattatagatgttactgaccaaagggaaaggcctggatagagggaattataggagtaaagctatcataaagaccctgaatacggagaggagaaaccaagaagaaaatgtataattctcttctaaataaaaatggtaattcttataaattatctatttataattttgccctagactagcactacactatttttgtcaagaatgatgattaaaatttcttccattggcctcatgctttttacagatttttcccagttgagtttcaggtagagaagatctgaagaatagagatggaaaatatcattctttttttaaagaggagttctagagaatctaaagtttttttttgattgttcaatagttagtatccaaaccattagaaaaactcagatcttaaaacagctaaccagtcgggcgcggtggctcacgcctgtaatcccagcactttgggaggccgaggcgggtggatcatgagatcaggagtttgagaccatcctggctaacacggcgaaaccccgtctctactaaaaatacaaaaaattagccgggcgtggtggcgggagcctgtagtcccagctgctcaggaggctgaggcaggagaatggcatgaacctgggaggtggagcttgcagtgagcagagattgagccaccgcactccagcctgggagacagagctaggctctgtctcaaaaaaaaaaaaaaaaaaaaaaaaagcaactagccaatagactattcccacctgtaaagccttctttttactaggtatggtggtgtgttggtcatcaagtacacagattaacaagacaattcctgccctcaaggggatgaaaactgggtaagaaaaaaaaatttttttcagtccagcttgttaaataccatattggagaaaagcaaagttgtcagtggaactcagacatggggcacttaagctatcaaggatggaagtgctccgtgcacattcatgagatggaggtgggaagtcagacaagttctggcagggacattccctagctctgtccaactagtttagtattagctggcttctcacatttgggtgaggtttatggtcatcgaacttcctagcctccattaggaaaggtatgaacaatcagtctgtgcttctaagcttgattcctttggattttaagtgttttctgtttcatgagaactttgttaaaatgcaaattcctcataaatgtttagccttatcagtcagcaccatattgggaatgaataagcactgtgggatgtctaaaggaagggagttaagagacaggctccagcaaggagatgatggtaattggaaagatgtacaacagttccaaagacaaactatattaacttctctttgtggaccaaggttaggcaagacttctgtcgaccagttcttggaatctttggctcacttcaaccgtaacttctctataataaaaagtaagaaaagtaaagagttcattggctcagagcaagttaatcagaaaggattaaagcacatcaatctattttcatgtttgatagtagccctcattgaggcttgtgggacaatgatcaggtccttattgagcccagcagagaaggaggacccaatcttgctttatttctccccctaccctctttagtgctattttttttctaaaattgccctttcctttgttcagttcttcatcttctttgacaaggaattcaaaaactctcagaaattttaataaataatttacagtaaatatttatgacttaatatgtcatatctaaataaataaattgttaatgactaaatcaacacaacaataatgttagtaattgaatgttggaagtcacagacttcagcccataggtaaatctcccctctgcacacccatataaaaggataggcccaacaaaagtaatgaaactgggcattataatgggatcttggccatgagacacgaggaaaagaaaatatattttttaaatgggttgatggatgtttctatttataccaagtcactgatgttggaaagccaaatgagaaaagagaagaaagtttttatctaagaaatgtgagcccctttaaattatcaggcccagagaggctttaaaatgtgacaacagtcacatcttacttcccctctatgctaaacgattacctcttgaagccacttgctccataggctctagattaactgatgccaagtagccataaaatgccacacactggacaccataacttataacctatagttcaataacgtataatcaatcactaatcaatgttatcgctgtattgtccaacagaccgccaggatggctaaatagtataaaggagagctttattggcaatatcagtttgcaaaccaggaagagacagtctctggcatgtacctaaagtgctttctcttcaaagaggtaaaaggcaggttgatttttatacctcacagtctgtattacacaatagactcatacatactcagccggtttggggggtatgaggagagtcaagcacatgcacaaggggtaaacatatatgtaacatacttcccatgttcactttgaggtagagttttagcattaaaacaagctggaatttggctctttacatcaaaggtgaactttaaggcacaaagacagtttgtgtgcagcctctgaaagctgactgaagctggattaaagtctggagttgcttaagaggaaagaatgtttgaaggccactcccctgtccaatcagagttgtagtgatctgggttataaataagaggtagaaagggagtaacaatttgcttgatagctcctattgttaggaagtttagcaagagtgtggggtttttttgtttgaagctgtaagaatttaggaagttgctatgccagctgagctctgaattctgcgcccatagataatatttattttcttaaccttggggtctgtcttagttgataaaggagcatctattttggtttctcagatcacatctgtaaaccaacaaaaattcctgtcaaacaacttcgtatcagcccactctttttttcccttttccctttgaaaacctgcttgtaacaagccaaatgcagcacttcccagggcaacttggaaatgtgtcccagccattgtcctcactttggctaaagtaaactcttccattaaaattatatctgatgcctcagcttctttctttaggtggacataagtcatttcgaactcctctctatccaccgcactacgcatattcacattttttccatgtttttccaattttgagtctgatatgcttcttgaatcagtttttcaccactttccatcacctaccacctctgctctgcatcaaattgtcttctgctcaaatcagtagactatttccttacatgaccttcttacctttagccttggctcccttagatccatcttccccaaagtttccaggtttcaaaggcaacatccgatgatgcaaattctctttcaatagctccacatcttctttggatgatgctcagagcttctctccagtgcatctgaagcttttcatataacgatgatgaagacggctgatttttactgagcattactatgttccagatacattggatcagatcttttcatggacattacttactctctcaaaatagtcccctagaatagatgtgattatcctccttatgtctcttttacagaagaagaaaccactttcagagtttatttgccaggctaggaagtattggagaagagatttggtccaatgccagtcattaagtcttcccctgaatatgtgctcacaactagtatattacacttccctgcatctcctaaaccgaaatgacaaaccaaaacattttagagacccaatgtgtaagaataattgaatggaagtgatttcagcaaaagttcttctataggctgggtgcagtggctcaagcctgtaatcccagcactttgggaggccgaggcgggcagatcacgaggtcaggagatcgagaccatcctggctaacatggtgaaaccccgtctctactaaaaatacaaaaaaaaatttagctgggcatagtggtgggcgcctgtagtcccagctactctggaggctgaggcaggagaatggcgtgaacccgggaggcggagcttgcagtgagccgagattgcaccactgcactccagcctgggaaacagagcgagactacgtctaaaaaaaaaaaaaaaaaaagttcttccataattcagttgggaagagctaaactagccagccatatggttcagatgaaccagtgatctcctcaaattgatgtccagtgcctcactccccaaggtaaatagcaatgaggaatggttctactgacctccttaacttgtcataaaattcacacttttattcgttgtggaatgacacttttaatatttcttttgtagaagaaatccaggtttccaaaaagccactgacaaacatttcaagttaggcctggtggcactgcacttaaatcagtagttgaatttaatcatattcatttttgcactgaaatatttgtttctgtaactattgaaaaatttcactttgctgtttttttctctaaatgatcttttatttcaattatggaaaaatagaaaataaagcttctgaaacctatatctgtcagaaataatcatggaaatcattgggcatgtcaatagccatgttttaacatcaactgaatgccctttaagcaggccacctgtagtttgaattgtgcaggaaaaagaaaattgcaaggataagctcattttttcctgggaatatttcatagaaagttgtgctcaaagatcaaagtatgattagaatttttaatattaagctctgggaatggaaattctctttttatcatacataaatatagtttgaattatgcatagtctatcttcatgcatgctttcagaaggacatttctcagagagaggaagatgcacatggctttctaggttttccacctggaaaaggaagaaattcaaatgtttggatcccaattttcccagcatcatccttttcatgtccttaaaatctcactcagagaagctatttctttttcactcctgatagcaacagcgtgctgttggcctggagcttgatttgctgtagaggcagtaggctggggcttctctggggaacactgattaagcaggaattctgggagcaggcgatggctggcagagtggtggaagtgagcctgtgagggcagcagcagcacacagaagctcagtgtgcttctggtgacaaggtcttcagagactcttcctcgaggctggtttgcagctgggaacatcaatctctctcctgaccaggggcttattaacattctgagtatcactttcaattaaatttctccaatgctcatttagtttctagttaataaggcaggactggatgtcatgtatgatccagcaggttgtttttaaaggataaaaataaaaggagccctgggataagttaaagcgtgaggcactgttcctgggccaacatgttgcccaaaccactggcctccattggctttgcaggtggtctcagggcatgttttttaatgtacttttccctaatggaggatttcaatcagatattcactcttaggaaaaccaacacattgttccccgatggctgcacaaattcaaccagcttttttagttcaaattattgtgtgttttgtgtagtaaagaactcctataaacaaagaatggaagtagtttctaggaggtaccacaaatagaattcgccagcctctgaacagcttttttgaggtgataacgctaataatgaaaataatagcagtgagagtcactacttattcagtgtctattatctgtctatcactgcggtcagcacatcacttaaaaaccctcatttaattattacaacaatgctaagaggattaatgtccaattttggatggggaaactgagatacagagcttaatatccccatgatcaaagggctcatttgtgctaatagagaagtggtaactgtgtaaataataatcagtgtttcatcttcaggcttttccttcttctcttttccatctacttgaaagacttagaacagtgtagaatagtctcagcttcaaaacaggtctccacagacttcttggcgaacagaccactaaggtagaagggtgataaagtgggaggcaggcagggagaaggaacatagccccctttcctatgggaggagccaggaggagaagatgcatacaatcagcactttctgctctaggtcaagatgccctgcttattcttctaacctgggacagcagagacttgtcaagggctccaagattttggagttaaaccctaatctgggccctactatgcccttttctagttatgtgaccctgggaaactgacattattctgagcctcgggtgtttgtaaaggcatgactctcccaccctctggttaaaaaccttaatcctaggtgacaggagtaggtacatgaaccaggattggtcattcatagtgtctgtcccattctcttggacacataaatgactcagaaatggacttttgacttctgcaagccaggtctgtccagagaagcggactgcatttggagagggttcactagataagtaagattttcaaccagcctttgaccctactctacagggtaaaattacagaatttgattagattacattctctctacgtccaatgagctctaatcgtctattattccatctgaaggaaaatacacatacagtgtctcattccgtatagttggattatataaaattacacgtatgggggtggtgcttgaggcaaaatctgttaggtagtaatgaataactaaaacaaagaaatgctttaaaaggagttttgcaaaatggctctctgcactagagtttggaggtctcttttgaaataatgtttgaaaaccaacccactcacaagaaactttgtaatttttggtgtttttctttggcatgtgattccagacccataatgggagggaggtttaacggagacagggtttataaaatgctgagcggctgtgattagagcacaacggctttgtatagaaatgtgctaacaagaaacaataagtggcatttgaaataagaggcccaagggagaataggaattcatgaagaaaagaatgttaaaataaatacttgctgagtacctaatgcattcaaccaaaagcaaaacttttaatacacatttccagttgaaaatcagaaggtggcagcactgcttactgaatagtttcagatgaagcctccagggaaacctggagacagaataagccattttgtaggttataagcgcagctaatttatagctaaaaatgaaatgactatggctcatatgcacccctgaaacctctgagcctcttcggggatttggcatattgactctgtcatgggtgggtttcacctccaaggatgcagtgaactcagaaacatgccaaaatgaagagcaaggccctggccaaatttctttccatctgaaatgaaaaaggaaaagcccaaagtttggtccccacaactgaaacatcaaagtcccctgggaatttgtcagcaatactagttttccagcctcccctcagatctactgaatcagaagttttgagagtgaggtccagaaatgtggattttctaaactttccagctgattccagtgctggcttacatctgagaaccataaggagaggtatagagactattgttgtgatctgtgtttcaaaatgtggaacacgtcctcaaacaatatcttgctatggatatgtggactaacttcgtggtcctatttatagcctcagtcatattgaacagaaagagtgggcaaaaacagacgacttgcaagaaagtaattccttaaaaatggaccagaacaggcagtaattgatgaaagcacaaactagaggttttccccacaacatattgaatttctgcctacttgtcaatagctcagaaatcttcagaaaaataacttgttttgctgtgtgtcgttctatcagacaaatttacaagttattaaagagaaataaaactttgaaaattatttttaagcattctctgaataaatgcataataaaaatattatttgttcttactgtccaaacagaaaaaaaaaatgctggaggtgagaagtcaattacacttaaaaagcataaagactcttagaagtaattttgccactttaataggcattgactaaagcctagtccagaataattcatgcctgttttattaattaactttgtggttatacagtggagagtagataatagggccatcatgtccattaaatgaaagaacaagaccacagagggcaagaccacagacaaaccacccaaagtggtggctggctattctcagaggccttcaggagggacagtactttggtgtggtcatgaatttccaaggttttattttaatttggcagatttataaagttcatttttgcctggcatgcagagttgatcagttttgcagagatagtctttgtaaagaaacccacaatagagtcatatcaatattatctaccatgggttttgttttttgtttttttgtttggttcgttgtttgtttgtttgtttgtctgagacagtcttgctctgtcatccaggctggagtgcagtggcaggatcttggctcactgcaacctccacctcctggattcaagcgattctcctgcctccgcctcccgagtagctgggactaccgacatgcaccaccaggcctggctaatttttgtatttttaatagagacagggtttcaccctgttaggctggtcttgagctcctgatctcaggcaatccaactgccttggcctcacaaagtgctgggattacaggcctgagcaactgcacctggtccagcttttttttttcttttttttttttttaaacttgctgtgagccacggaagagccagccagaaagtctgctagctgatccacacatagccttggcaaatctaaatggagggtcaaatctggattgggaatggatgtgaagaacacaatatcgggtcacaaaaaaattatctggggcatcttaatacactaattcattcatctccactgtggatagagacctgtctctctatttgggtttggaattcacagcctcgttactcctggacggtatgtactcagcttctctgactgatttgtccatgctctgtgccaaacctcccctctcacttgaggcttttttttttttgaagtatgttaatatcatttattgagatttagttatatgtcattaaatttccaagaatgcctggtcatgggcaatattttgtctttattgtccttgattaacagcactgtacttctactcctgctaataatagtgtcatatttttcttttaatttggtttcaaggtctctctcaggagagcagctgtaaactctagccctgccctgacagtgctcttggggaggtggttgtgggtgtttacagtgtaccttccgtgggatacttctttgttctggtggaaaacctgatgcctaagtgtccaacgtgtgaccagatatccctctcacaggaaacttacttacactggcagatgcttaaggtcttgtgtgacctatgtccaatttattcctacaaagatagccattctgtaggagaactgactgggaaataggttcaggtgtgttggtcataggaggtggcacaacaaaacacatgaaatagcagaagcagtatattactcacaggtcccagagaagaggagcaccaatgagcaccaatgagaaggttgtggggacaccatgcgcagccaacaggttgggatttctaattggtggacttagagcaagcagacaagggtcacatgcattcatgttataacttaggagtgatcactacagcctctgagcacattccatgtggagtatgggactcagtaggatgagcctggtcaattgttatctatttttcccatatgaaagtggatactaggaggtgattttatagggaagatatcacgtctggatggaatacaagaagaaactgggaggaggaagacagctggaaactgggtcaaaggtgactaagctctgcttctggtgtgacagttaatgctatatgtactaaaaatgaatgccgaggcaacataaaattacaagtattccctatacatagctatcatgagagctcctaggtgccagagcctgggaatattagactgcttagttctagacctcctgaagtttacattgcagttaagaaaacaggaaactggacacacgactacaatttagtcatatggagcatgcaaagaggggagaagttgtggatgccagcgcataagagggagagtggtccttaattttgaggtcagagaaagcttcctctggcaggtgctaaactccaaacattagcagaaaacaagagcttttacagaccaaatgagttcacatggctttggcacacactgtgtggggattgggggagagagtaaaatggggaaagatcatgctagagacataagcttgtgtgagatcaagaaggatttaaattaagttgccgaagagtattttatgttggtggtaattgtgagacaagtaatagttttgagcagaaaagtgactacacgtaatttgcattttagaaaactcattcttatggagaaattatactatggattgaaaaagggtaatgtttgagggaggaatgccttgggttttcttgttttatttgtttttcaatatagatggctaataatggccgatagtatactcttactatatgccaagcattttacttgcatgttctcatttaatttttataatgatgctgtaacatagattgcactaggaattatcctaatggcacagagaagaaaagaaatagcaataggaagtttatgtaactcccccaaggtcacaaaactggtatgagttagagctgagatagaaactctatctgacgtcagagtctatgctctatttcactgcacccactgctgccttcaagctagagagaagataagctgaattagggagctgcatccagaaagtaaagaagaggacacattgggagctattgcagagcgagaaagggcaggtcttgacgactgcttggaggtaggtggtgcgagaagggagctggtaagaagaagtcttaagtttggctcaagatcattactaattttgctcccaacttcagtaacttcctctatatccttggacagtcttttcacttatttcctggtcccatctcttttgcttcacagtagcaatccaaaaattcctgctttcttctgcagacaccatgctactccatccctcctcagcatcaatggatgattacaccttctgattgttttggatctttggctgggaatggtggtgatgttcttctttgtgccaggtctaaattaaagaattggctctttatcacaacatttagaacatactatgaaaagaaagaaatcaatgaaaaacaggacctctttatttcctactcataataatatcaagtaagaacatctatttccagaagtagtttttcagccttttgctagagagagtttgttcttttgtttaaaatgcctgagctgataaggttcccagcctcaggagggacagatagagaggagaaaagttattttcccagaaatggcaggatgcattctgaccccttcctttatgttttagatgactgatagtgacaacatctaatagcaacttttattttctcatttagggccagtaaggctagcttttgctgttttcaaatgtaattattatagagtattgaatataacgatccagagaaagatccagatgtttctattttcttccgtagaaataactcatctattagatataatagacagtgccttgtggtacagcagtttaggaatatcattttactaagctcatctcttcctagatgcaggaaagtgaggactaagctctgatttttttatttgcccaaatttctatctaaggggtctagggactaatgacctacaaaccataaattctcatcagataggttttatttaaccctatatatcatggcttactttccaatctgaccctggcataacactatgagacaaggaagaaaataaaaatatttaactccaaaatagatttccttgccataccttgaaattggcctgcaaagtcttttatgggaaaaacccacattctatagagaattcccttttgttttccttccttccttcccagatccaagagataatcaactaagagtcaggcacccttttaggtcccataagaaatattttgcaacctgctctctctctctctgaagtctgctacctgagagctccctctgcacaataaaacttggtctccacaacctttatcttgacctgaacattcctttctatcaatcacaggtctttaaacaaactcaaccaattgtccaccagaatatgtttaaatttacctatagcctggaaacccccactttgagaagtcccgcctttctgaacaaaaccaatgtatttcttaagtgtatttgattgatgtttcatgcctccctgaaatatataaaaccaaactgtgctctgaccaccttggacacatgttcttaggactcccctagggctgtgtcacaggccatggtcactcatatttggctcagaataaatttctaaaaatattttacagagtttgactctttttgtcggcaaaagattatcacagaaaagtgtctgaaatggtctcttaaaatagtctgtctctcagttctagttgttatttgcaacagatggaaatactagtctttgtggcatggttcaagtatgagtttgctagaactgccatagaaaactaccacagactagatgagttaaataacagaaatttattttctcaaagttctggatgttggaagtccaagaccaaggtgttggcaggtctggtttcttctgaggcctctctccttagctcatagctggccaccttctccctcatgttctcacatgcccttttctctgtatgtattcctgatatctcttcctttcttatatgggtaccgatcagattgcattagggcccaccttaatgatctcattaacctcatcacctttctgaaagccctatctccaaatacagtcaaattctaaagcactagggcttaggatttcaacatacgaattttagggagacacaattcaaagcacataattgtatttactttgctgttatccaaaagcaatagcaacagtgagaaaaagcagaaaaagagctctggcctagaaaaaatatagaagtattacaagaacaccacccagtctgataacatttccaagctttggcaccagcgaatttttactgcttgcaaaaaggcaggcgtgaatttcttctgttggggtagccctattttggtttccctaaaaaaagcaagagtttcaaagtttcaagactctagaaaatgtaaaaatctttcagatggtttttactgccattctttctctgtttcaagagctaataaacacactgttattatcatattagttttatccttccacttatgagattttctttcttttccttttttctaatgaccaagcaaatcccctttctatgagcataatgaaggattttgcttacaatcaggcgtcaccctcaaagaggtgaaatatcttggctctttgataatctttcatgatcacttccaagaggaactttgcaggcatttgagttgccagacgtaaaatttggctttctgaaaaagaagcacatgtaactagctcataagctgcagtttgttaattatttttttctaaataaagaaaaaatatcattgaccagagtgatgagtaggagactttaggactctaaagagggattttctcaatgttcactctcacttcaaccctccccctacgcagaaacttctctacatctacttgtatatttgtttcttcactactaccatctaagtatagtagaaactactactaagaagctactaagctacacttagcttctactatacttagatgctagtagtgaagaaataaatatacaagtagatctagagaagtttctgtgtagggggaggattgaagtgaaaatgagccttggaagaagcatctaagtcatttccaactcttcttccactactgtgaggaatccatgtcctcctttctctgggcctttgcatttccaactatcccctctctaagtaatgccatgctcctccctccactgctttcctcttctttaactctgtgcgtgctcatgcctcctcccagatatatgatattatgatacatctacctacattcgagttcaattctgagtttctcaagtgcaaagatatgtcatatctttgtgtttccactgcctagcatgattcctcgcttattgttatttcttgataagcatctgatgaatgaaggaatgaatggatggatttacatgcatacagggcaaaacaacagaagttgattagtcaagtaaacatattttaatgatggcaataattgtttattgtttagaaaaataaaataaaacattcaatttcataaaagacagaatctataaaatcagaaaaatttatagttaattatctggatagtaaattttctgaaaataggcaatgttgataatttaggtaaagcttactgtctccttcatttttctgaaacagaaatagaggtttgaatgattttcaaagatgatccaactttcctcttgctcttggctatgttctatacagtgcaaattgagaagataaaacctaaacatttcattgtagtttgtctgtgttcatgatcacctggatgttttgcatggtatagatgtactcaggccttaagagactctctcagaatattcaggattctacttagtaaccctaggcttgctagctatttagtgggttagttttttaactgctaaatattttctgagcccttactaaatgtacagtaattgtgtcaagtattaggaagaacatagaaacatgtataaatgtaccttctgtaattgttgccatctacggtattatccaagacaatagacactaaattaaaacgaaatagtagagaggaaatgcttatgatctttaggaattgttgctaattgaaaaaacaaacaaaagaaattcttaacgttggcatgtttagtggtaattaggacctgtttttattgcatgctggatattagttgttatgtgcttattctcagctcattggaatacaagcagacacatctccaaaaagcagaataatctcaggaagacgttgccctctcctgagctaggtagaaggtcttgagctgtagcctgaactggtgtctgattgaagaatgcgtgcaggtgcctcctccatcagtctggtcccagaagacatcttgcagtttactacaagtttttaagaaagatgcagcggtctgtgaaaaggctaacatttctgcaggagagagaaatctgcctgacagataaacatccctccagcctttcctaagccctatttgtaaagaaagcttgatggaaagggaattctgtacaacttcaaggaaaaacagtggagagattgaatcaataggaagcatcctccttactcccatttcaggaaatccagagatcagtgtgctcttatttcaaaaggctgtcatccaacagagtcacatggtgatctgaaatcaccaaagccccagaggatggcacagggcaatgcaaaaagcatgaggctgagagtcaagtgacatgggttctgttctcagttctgtcaaggtttagctacatgaccttgggcaagccacataagcctgcttcctcagctataggacccagattgttttacctttgtctggcaaagcttttacgagaatggaatgaggtataatatgtaagtggacctgtattattcaattcttacattgctatgaagaactacctgagactgggtgatttgtaaagaaaagaggtttaatgcgttcacggttctgcaggttgtagaggaagtatggctgggaagccttaggaaacttacaatcatgacggaaggtgaaggggaagcaggcatagtcttcacatggccagagcaggagagataaaaagagaagaggggagtgctacacactttgaaacaaccagatctcatgagaattcactatcacaagaacagcaaaaaggaagtctgctcctgtgattcaatcacctcccaccaggcccctctttcaacacatggggattacagttggacctgagatttgagtgggaacatggagccaaatcatatcagtactcaactcagtgcttggcatatggtaagaacaaaaccacaaccatagctagaggcctttctcgggcatgagcaggctgtctggttggaggatttcagggagcctgagtgcactttacccattattccttctctcactgctatgggacaccttccagatacatagcttctcagctgattgcttcagtgacttaataatggataaactgcttcttctatctctagtggaaaaaataaagcctgggacacagagtggctcaaaggggagcactagcctgtgtggggagcactagcctgtgtgaggagcaccggcctgtgtgagaatccctgctcaactcctgctcagctctatgaactttgggtgcattcattgtttaaagcctcagtttccttatctgtaaaacaagggggctagaaatatggggtagaacatttgaggtggactaagatggaaaaggagaatagtaacttcccactgacctgtggccctttcagtggctgctctgcccaagagccatatactcatgacttctgatggggacaaagacctaaagcgcttgtggtaattgtcctggaatccttccgcaattctattctttctcctcttcagtcgtttatttcttccagatatgtggggagagcttagggtgcctcatggaagcccagaagcccacccctgaaatgtctcccctatcctaattcaagacaggtatggcctgcagttcccagcactagaaatagagtttcccttcaactcatcccctatttactctgcccatttcctagtttgaggtttcaggatctgagtttgctatcaggattgaaacatcaaagtaccttagttttttgtcacatttgctaaatggttgtcattctacaaaatgttttgtacatgttaggaaaatgataatctaaataagggaattaccatggaggagtttctttgagagatttacgtgcaggggattttctaacacctctttcaaccccttttccacctatccataagccctcttaggaacaaggcaagccatcatttgtcaattcatataaatatgattaattgtatgaatgacgactgaaagctaaggtcaatttctgatgtagaatctatgttcttggaacggtggctcacacctgtaatcccagcactgtgggaggccaagatgggcagatcacctaaggtcaggagttcaagacaagccttcccaacatagcaaaaccccatctctactaaaaatacaaaaagtaaccaagtgtagtggcacgcacctgtaatcccagctacttgggaggctgagacaggagaatcgcttgaacctgggaggtagaggttgcagtgagccaagactgagccactgcactccagcctgggtgacagagcaagactccatcacacacacaaaaaaaagagagaaagatatctgtcagttttacctgccaggcattcatttacattcttctggtggcaacgtttagattttcctttagggaacttctccattgcatgcaatctcattgttattttcaaactaagagcccctcattcttaaggagtggaaggtaacccagtctaactcaatcagactatctcttctcaatacatgtgttttcagcaaagtggctcaaaagtgtaaactatcaccaggtcattcattcatcataaaaactgtggaagtcagtgttgcaattcctctgggatctagaactagaaatgccatttgacccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgtaaggacaaaaaaccaaacaccgcatgttctcactcacaggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtaataataaaataaaaattaaaaaaaaacttaaatgtacttctattcttgctccctagatattcagagatatcttgtttctatccttcgtatgatcaggttgttcaataattcctccaattctgtgggctatccccttccaataagtttatttttcactctaagccagatgcatttcaagtgcctgcaaccaactaaccagactaagtgaaaaatgaaaggaaaatatagcatatttttgaaggtctgatgttggaggcagaaacagactatggacaagtgattaggttgctttccaaaagtttggtcctatttcagtcgtttaaatttggggtccattttcttcatgggatagtttctgtagtatatactgtacctgaaatatagacttcatgataccatagtttagagtaattttgaataatgattattgtgaaatctgttgagagttccaaatttaaaaaacattactgggttccaaattaaatagtttatttcctgtgggatatgtggataacaggtactttatatttgtggcatttatgttattaaaataattttacaaggtaattttatcttcatttttctgttataaagaacttgaagctcaaatagggaagaatcattgagcttatagaagatttggatgggaacccagctgtcctttgttacaaagcctgcactcctacatctgtctaccaaagctacttaccaggcatgcataacctttctgtaccttatcccagaaccaaaggagaatatctgcctatcagaagaaagataaataatgtgagtttctttccactattattcttgcagttcagggtaatttctgtgcagcagcaaagactaagagagccacataagaggagagctggatgggtgctaatgatggagagagtgtcaaggagaaaggaggtgttgggagtaggtgctctggcttaaaattcttggaggagagttcactcctatcctctccttgtttctcatcttggcctataggaacaggaagagaaagcagtccggagtctagccccctattatatgttcaattgtgttccccaaaaagattttttgaaattctaacacttggtacctataaatatgaccttatttggaaataaggtctttgcagatgcactcaagttcagatgaggtcattagggagtctctaatccaatgtgattggtgttcttataagaagaggagaacaccacgtgaacatagaaacacacagggagaatatgatcacatgaagatggaggcagatgctggagttacgctgtcacaagccacggggtgcccaggaccaccagaaactgaaagaggcaagaaaggattcttttctggagacttcagagagaacatggctatgtagataacttgattttaagcttctttcctttagaaatgtcagagaataaatatgttactttaagccaccagtttgtggtactttgttccagcaggggatttacctaacaccacaaggagtcaacaaaccagttgcctaaagagccaacatctcaaaaattttacctttcataagtgcagatgtacaaaaaaggtatctcttctttactgagaaaattttaacatttttacatatgtgcacaatacttacacaaaaagtcaacattgtattaatttactttcatggagtcacatttgcaaagaaacatataaaactagaattctctaacagcctttccataatttatacctccagtacaggaaatgatgcaaagatgaaatacatagcacagcaaattgcaaaaactaatgttgactaatgttaaaatagtgaaaaaaaattaaaaaggaaaaagaaaaggagaagaagaaaaaactaaaaaatatttggcatatgaaaagtataatgcaggaatagattatgagcaatggcacgtagatagttcctaagagctggctgatttcacaatcattaactatattttgaaatcttgcatcacaattaatagctgcttttttttcttttaatacatgctttccttggagaatacattcacattcattttttatgtggcactgcttttttgaaattcttctttgattcagcatatactaatatgagcattccctattacattttcccatcttttgcaccttgtttctatgttgttttgggtatgcagaaatccattttgcatgcactcaaatacagaccacacatttgaaagaaacaatactggtgatcgaacagcaacactgtgtgtttaagtgttttcttatcccaccatgtacataatcatttttgaaccagtccatcagcaactttgctggcttcttcaggcaaatgcaactttaatacattaaaatctcctggaagtcatcagctagaagaaatgccaatgcaggcaaacgaggcatttttaaactgaagttttagtccttgccatatcgtgtggacaatgcacacatttgaattttttgacaaatgcattgagctaaatggaagaaaaaaattttagtaacaccttgaaattcacttttagaagtcttaatcacacctaattccaaatccatcactatggttcagagaatcaactgaaatccattttcttctgcgtaaagacaaaagcaaggtaatagctctgcctaacatgaagcaatattcctgtgactgtgatttttggaattcagatgttagagattttagattttagggattttgatctttagggattttggtctttcaggctttcaacatttataattatggtgttcaagagtacatcttttgggattatgattcaaatcctgattccccaactgtcttcgggaagaaggcaatatcatgttgtgagtttatggatgaatggaaaaggaccacagcaaagttgaatttgcttgaagtttctttttttttctttcatatccatacccttgcatggaaatagaaaaaaaaaaaagtagctcgtaaagttaagaatatggataaaggcaggtaaaatggaatttttaaattttgagaaatcacagatacaattattacaacctctataagtgaaaataagcaatattcccaaatctacaaaatgtgaatcctgtaaaagtgtatcaagagctcagcatccttagcctctctgttgattttgagtgtcaacgctgcagcccactgattgtgtgttctctttgtgactgttttctcacctataaaataaagattgtataatgaactgagtttgctcatctgtaaaaggtgaggttgtaaggattaaatgatttaatacttataaaatgtaaaacaagaagtttcatagagccacatgggaagtgcttaatacgtgttagctattgatagtggtatgtcctataaataagattgcctgtcttgtcttggtggtggatgtgatcgggttcaaaaataaattgggttttggtcttgtcctcaggtagtttgctaataagcaactttattacaagatcgaaggttataagtattctaagcaaaaccccaatttctaggccacagatactgaaaaggatacttcccagcaatggtggcatttgaagtggacttgaagcaaactgatatttaaccaagcagagttctgattacatggagggattggcacaatcaaagcacagaacagtgtaaagttcctgattcggttgagtagaggacacagtgattggacatgcaacatagctggacagatctgatgatggcatgccctgctgaggattctgaaccttatttctatgggcaacaaggagtcatagaagatgtttgagcaaagagtaataggattatagcttcagctgtaaaaaggcacacacaaaatcagtttatctaaggagactattggaagtgtgggaagttagagaagaaaaggccaatttggaagctattttcaacaatcgaataagagacaaaaatcagtgaagactgaacggtagttgaatttgtcattgggaggagttaatgatttgtatcagaagttaggatggcctgtgctaacattagaacatgaagatcagagagggagtgattctgagcaggaagtagaagagaatgctaaataaagtgagctatctacactgacaaataagtttgaaatagaggcagttatgcggagaatgcaggctacaaaatggtgttacatgtagaagagggataggcgagctatgacctggtggaatcttggttgatgcctgtgtttgtacagttctttggctgcttttgcactataagggcagagatgagaacctgtaacagtgaccatatggccacaatgcctaatttgtttttttttagacggagtctcactctgtcgcccaagctggagtgtagtggcacaatctcggcccactgcaacctccacatcccaggttcaagcgattctcctgcctcggcctcctgagtaactgggactacaggtgcccattaccacgtctggccaatttttgtatttttagtagagacggggtttcaccatattggccaggctggtctcgaactcctgaccttgtgatctgcccattttggcctcccaaagtgcttggatgacaggcgtgagccaccgtgcctggccacaatgcctgcaatattaattactgggccgtttacaaaaattgttgctgatccctgatcaagaatatcttgataattgaagtaatatttgaactcaaattagctaatataactgccttgttattccttttgaagtgttttgaaaacagcttcagaggtttcaaagactttactagaagcttgggaactagcaagcttctaaaagaaacatgtggatggaggaggtacctgcctcatgccagagtttactactttattgacaaaaggtcaccacacaaacatatgcaaacaatagattttgtttatttaatctatcaaacatatgcaatgatagattttgttgtatttctccaggaagaagaaaataaaaggaacatattatcagattattttaattcaaggtcagaatttttttaattaaaattggattctagtctgcaagtgagtgcacagagagcaaaaagaaatacatggtatgatggctgccctctagaaatttttaattttccacaaacaaatatccatatataaaaataaatgaaaataatataaggaaatgctgactgtactgaaggagaagtaatgtgataattgatttccatttctttcctgctttccgtctgtttatagagtcacggacaaagacaagtgtctacagaaactaaatgttttgaacatcaggacactttaaatacaaatccagagaaggggcttctctttaaatatcacaagaactggcaaaagttggcttgcagacctcccaagtcaggaggcctctggaactggccgtgtgagcctctgttcacgtagtccccactgtcctttctcatctcatgctgagtcagctttcctaatttttatttcccattggtctttcaaagcaattgacttgtaatccttgctttggaagtgctatcaacttcatcatggttaacagcagcagagaagggagcccctaacaatgtgccttgctgttagtttcttgactacttttgtgccatttcccactgcactttcattttgtctctccttttctttatttccatcactagttttccaccagcaggaaattgccagaaaagaattacacagctgaccctctttcctagtccctgtttccttttattcacctctctttcatcctattccctcttgtttcaatccttacccaaatgtcttttgaaatgccaatagaaataaccatagtgacactttgctcaatagatgtcccagtggttcaaagagcaatcctctttggcctcacccactgggttctatttctgctgagccaagtacatttaattcactcgttcatttgctctgaccctgttatcagtcttattttttctttccttcctctgctcccagatcagaaaaatcaatacatttgttaacaatgtaaaaaaattaaaaatcagtcaaagaaatcagggaactaaagtttcaaataggtaagtgacttgcccatagctgcggaattcagtcttgcatgatcagtcctcaggagatggaagtctggacttgatgtctctggagcctagggtgattgcagggatggaacatagggctatgaaaggttgacctgagaatgatgctagaaaaagtgagcttctttcttcctttgcatttgatgagcaaaccccaaaggagagccaggaaacagattgttgtttagaactctgaataaggaatcaaagcaagctgctctaggagttttccaatgacaaaatggaaatggaaacctgaatgagtaatcacaaggaacaagatgctattatctttcttcagctgcctcatgccccctcttcacttaagcataaaatggataaaaatcagaaaaacaaaacctgtcaatgaaacattgtttctgaaactcaggttgaaacataaaagagacttccctaggctagtcactatatatacactgatatatacatatatgtgtatacattcttagaatactctctaaatatcacttagttctgaatgatgtactgtgtcatcttagactaaaggtcaagtgaaggagagttctctgtttctctcattaagtaactcatatatagataagagaagaattgagggagaatgatgagtctgccctttcccatccccggttctccacatttagatgttagtcacacacacagtattattcctttaggatgcttcttacctgataactttcctttaagaataataaactgttgtccttcactattaaaaatgggactttggtctgtcttcctttttatcagtcttttatcctttgtaagtgtgataactataagatcctttatttaagggccgttgaaaggatttttagacacaaatactatacttttgaatataaatataccaaagtcacctccaatgtacattttccatcacttagctgcattcaactgtgttgatatagaagcatttgtcatatacagcattagcatacacatgtatgtatggcattttaaaatgataaaatatatagaaatacaaaaaatgtatgagcacagtttaacacatggctgtaaggggaaaacctgaaaccattcctaagtcagaaattagaacttttcagaaaaatatgaaatgcttcatgagtttcccattcttcacagtttgttctttcttctctggatcattccagttggagatcatgggcttctgtatttttagtattattcttggttactacagtcccacttggttatttcattcaattcctaaaaatacttatttgaactttgcacttctgttctaaattttctagggaacttttttttctcatgtaaacactagatcatctcatttagttaatgcattcctcggagaatgtgctctaaaccagtgccactcaaattacggtctatcagtgccaagctgtaaactgttggttactggccccccatgaaattgagtgtagagactgagagtaagctcttaaaatatttatagcaatttttcaaagaaattttatgacttgaatccagtaataaaaaaatagaaacttgcacattttatctgtcatttttattttatttttctagacatttatttttattccattttacagaagtatatatccatgaaaaactggaagtaaaacaaaattaaacaaaaatctgttttcgtttttgtttttttgttttaccagaatagtttgagaagtgctagtgtagggagcagaaactgcttgcaggctgcatttccctttatggacccgtgagaaacatgcatcttgagcatccaaatttgttcacgtaggacaaagggaattttcttttttttttttatttttttttattttatttatttatttatttatttatttatttatttattttaaattttttttttattatactttaagttttagggtacatgtgcacattgtgcaggttagttacatatgtttacatgtgccatgctggtgcactgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgcgtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagcccttaggacaaagggaattttctaacatgagctgaagatctggagttcccagccatgtcttttataaagactcaacttccagaacagaatgggttgctttacttctatgttttcaccagcacctttcttgcccaatgactgccagtcctgtgccatgtacctcttttcttacccatcaataatggttaaaaattattagatttagaaaaggtatataaacaaagacacttattctagcactgcttttattttattttattttattttattttattttattttattttattttattttttgagacagagtctcactctgtcgcccaggctagagtgcagcggcacgatcttggttcactgcaacctctgcctcctatcctcttgccttggtctcacaacaagccgggattacaggcatgagccaccacacgcagtccaagcactgcttttaaatatcaaaaaatacatgaacgccaaagagaaaagcgttagtacactaaatgatgctgcatacaatgatggcacaactgcaatcattccaaattatgttgtaaatttgtcctagatcctccacataatgctgtgttaaggaaataatttaggctacaaaggagtatatttagtgtgataagtttttgtaaagaaaatatatgtgttcagatgcagagaaacatgggcataaaaatgttctcaataattatcctttagtggtagaaatatgtgtattttctaagttttttcccttgtgcttttctgtgttttgtatcaaatacttttttatatgtttgtttaaagtacataaaagaaatgggaaagaataggagaactgtgaaaaaaatggagagtcaagtaatccaaggcaaaaatgtcatgaaggcaaagtatgttgaaggctgagtggaggacaggaaacaactccatgcaatggcaccagaattttggaagttgttaaaaaaaaaataagataaaaaactggtctcaccccagaccagattaatcagtattttagaggggagggaacagacatcaatatatttttttttttttgagatggagtcttgctgtgtcgcccaggctggagtgcagtggcacaatcttggctcactgcaaactctgcctcccaggttcacaccattctcctgcctcagcctcccgagtagctgggaccacaggcgcctgccaccacgcccagctaattttttgtacttttagtagagacggggtttcaccgtgttagccaagagggtctcgatctcctaacctcgtgatccgcccgcctcagcctcccaaagtgctgggaatacaggcgtgagccaccgctcccagccacatcaatacttttaacacttcctcaaggagcccagtgttcctccaggtttgagagtcgttgggtagatgccagccagcctattctaccaaattagtccatgctggctggctggctttcaggaataggagttacattattccaaacagaaggctaacaataaaaataacaggattcgtctctcacaaagcattttatcccctcagcattggtggcctaaagctgaggattatttgtatgtgattacaagttttggagacaccagttgaaattatctaaacattctgaatattaaaacctaagtatttaatgtgataaaactatgatctggaagttgaatggagtgattgctttgcgggtatacagagctgcatctaagtcaaccctcttgaaaatgttaattagcaccaaacaaagaacaatggaagatgtctgcttttttccttggagaccaagatagggacaagtcgttttgcatgtgcgcagaatgtggaaatggcaaagaggtttaaataacgaattttaataagtttcatcccactgggagagacacttctgattatctgtgacctatacaaattatcatgattctccccactggcctaccataattttaataagtaatcaaactaagcttgaaggttctgcaaaatgccaaatatatacaagtgcttttgctagttacaaagctagtacttgctacctgacctttttacaatttctccaactacttattcacaccccagccacaggtttaaatgctcagcgttcatttggtccttattgatcctaggctgctacctgtttgggctgagaaatgaccttctgtggacatctagggagtcttgccctgctgtgagaagaatttcaaaagaagtttggccagaaatttaatgcagatctgaaaaggttgctagcgaagctacatgtagtggaatgagatacaataagtccctagtgatggtccaggcccaggcaagtacctaagcacaatggcgttcaccaatgagctagcagaaggttaacgagggcagagcatatagaaacaggtgcttcgggctcctgggagatttctttacctctctccaggtttcaatctatttcctcactccagcctcactctccaaattgtaacttacatgttgggagcttaagctgaaaacctcattaaaatcttgttctcttctcctgccccgtgatttggcttttgcatccttgactctacaccagtactttttaaactttaatgtgcttaccagtcgcccgggattttattaaagtgcagattgtgaataggtcagtagatctggcatggggcctaagacatgaatttctaagaagctcccaggtgatgcttctgctattgtgccagaccacagcatgtgcagcatggccccagttactagttcctacccccagaatttatgaggcagttgtctggggtggggccaggaatttgcatttctacttagttcccaaatgatgccaatggtcagggtctacacactgagaaccactgccttagcctgctgctcccaactgatttgagctgtcactactcagaagggcaggttgctgccccttcccctgccatgtgctggttccccctactctcttggcagttttttcagggatgggagtcgaaagataatcatcttcttactcttcaggtatctgtaagatagaaaaagaaatcctgccaaagttgaagaacgtctcccaaccttttagacactgaaattctatagaaatagagaagaaaaaatgaaacaaagcaaaagaaaatgacccaactactcagattagagcctcgaattaaaaactgacagacaggctgctttacatcatcctgaaattacttgtgcctggtctcagactaaggctcctgcctatagctgtacagtaaagatatcagtttgttactcaccgccaagagcctgaggaggcaggactcaaggttctgttcatagcagagcttctcactgtgctcacacttgtgcaggcatcagactgtcctgcagggctgttaaaatgactcttggtccagggtggggccagagaacttgtgtttctaaaacgttctgttactcataggactggtaccagaccacacttagagaaccactcaaattgaatgacacccctgttttacttgcttccgttttccaccaattaagaaatggcagtcacaggaaaggaaagtaaaatcataggtttgctgatgaagctgaaatggggaaatatggtataggcagagattgtcaatggatttcttaaggctgaaccccagagttagacatacatgtgcacccactcacgggcagcactggatcctgtgagcatcccttgatggggacctgcccatggaaaatgtaagacatggagaaacagagtggggacacacacttcctgcaggcagctagctcctgaagagaatgaggaggggaaggggaggaggtgggcaagctcagttccttctgtcaaacccaacaatcaggtaaaacactccacactcccaaataatgcaggaaatgagggactcaagaaagatcaggtaggatgagctaggctaatggatgtccctcccttagaaacaggaatagtcaatcaatagccctcctcccaaagaaactaatgtccaagcttgccaaccccctcccacaccaaataccaggctttttgccccaatgagtttaatcagtaactaaattgagttcaaattctatcccagcttagactggttatttagcccgtatgagccttagtgttatgcctacaacattgggataatgtaagtcttatctccagtgatcgctgtgaggattaaacaagctatcactttgtatctaggagggactctccatataacaattttccttccttctctgtcttccttcatctcttagccttgtgacttgatatgataaaatatgttatattgtacttgctcttagaaaacctgcaatctcgagaaaaagtatagaaatatgaaaatgggctgggcgcggtggctcacgcctgtaatcccagcactttgggaggccgaggtgggcagatcacgaggtcaggagattgagaccatcctggctaacacggtgaaaccccatctatacttaaaatacaaaaaattagccaggcgtggtggcgggcgactgtactcccagctgcttcagaggctgaggcaggagaatggcatgaacccgggagggggagcttgcagtgagcccagatggcgccactgaactccagcctgggtgacagagtgagactccttctcaaaaaaaaaaaaaaaaaaaaaaaagaaaagaaatatgaaaatgttaaatacagcataaggcaatgttttgaaactatgaagagaaaatagtgtgaagactaaagcagatgatatgtaaaatgcttagtgattagtagttgcttagtttaacatttttctaaaaatcgcagttcaaactggaagattgggaaagaagctagagttttctatagtggctccataggaaatctgtggctttggttggcttcaggaggaaagccaactgctaatcatgggacagggtaaggatagttgagggatggggaacagcatgggccgaggcttagtacaagggacccgagagacaggcggacacacctggatgggtggtcacttgttctgttcacaatcagttcttgtcctgagccaatcaccagacttaaaaggtccccacgctgtagtcttttatatcattgcccattcagttcgcaggcattgagagcataactagtagcaatttctctgccttttatgtataatgattcgattgatttgaatgtcagggcatgtctctaagtctagagggtaagcagtccatcctgtgagggagcatagttatttttctttctttaagtcaatgactctctttgatggtggctgcacattcaaatcacctgggagcattaaaaatagtagcaaagctctaccttttatcaataaacttcaaatctcaaagggtggaggctggcatatatattttcttaagagctcttcagatgattctagcatgcggcctaggtcaggaaagtctgtggccaaggcagcctgttcactcgtgtggaaatggcatttctaagcattgatttttctcaggaacaattaggaagcaattaacaaacaattaaccagactgttagtatgctatagataagcaccaaacctgcatgggattttgaaataaaataaccaagaaaagcatgtttttcaaatgtaaactgggatactgttttacatgctaaataaatggcctggcaaacaaaggggctatatttatataaatggttaacttttagtcatgtttctaaatcacacgttattttgcaataaaataaagattatgaagacagaacaacttaataaaaacatgtacttgactatttgagttgagtaagatcatatttatcttttcttatgactaatagctagttggatattttgtttctgaagtggtaagctgtttaaacaagtataaaggagaaatcttatttggttagcaggaccaggaagtgaatctatgttagtgtccagtttccattcattaacttattcattcaataaatatttattgaatttcctccattgtgtacctagcattagactagaaagtggttacactgtttgttttgttgctgttgttatttttagagacagggtctcactctgttacccaggctggagtgcaatggcacaatcatggcttactgcaaactcatcctcctgggctcaagtgatcctccccgcttcaccctccagagtacctgagactaaggtgtgtgccaccatatccggcaactatcagtattgttgactaaagcaggtttggtttctgaacttctgttttaggtacttataatctaatggaagaaagatgataataaatgatgagttgtgctaagtgcaatgaagaaagcaaacaggatatagcaattgaggaaaactgtgtgtgtgttttgtgaggtgttctactgtgatagaatctgaagatcctatccactcttctgaaccaagaatgcagaataaagtggagccaactttcagacttagagcactgtaaggcagaaggcccaggcaaagaagaatttagcctgtgagaggctctgaaagataaatgtgctaaaatagggagtagtcacacacatgcattcatgataattatttttttcctcagtttgttcttttgcatatctttatttttccttttaagaccaattgaagtcaatatttattgagtattttctatgtgtcagtagttaaaatagtctgagacagtgctaggaagaaattaaaaaaaaaaaaaaaaagaaattaaaacctgatgggagaaacaaccctgacctaagagaggcagattgtacttgctcttaaaaaaagtgcaatcttgagaacaagtatagaaatatgaaaatgttaaatacaatataaggcaatgttttgaaactataaagagaaattagtgtgaagactaaaggagatgatatgtaaaatgcttagtgatttgtagttgcttagtttaacatttttctaaaaatcatagttcaaactggaagagtgggaaaggtagaggtgtctctaagaaagacatgcatacaagttatgaaagtgtgtgcagtcagaaaaaggcaaaggagggtgtctagctttccctgggggatctgcaacatcaggcaggaatttttccatgagaaggccctcatagaccccagggaatcatggagatgatccaaggatgtttggttggcaacagttaagctggtgaggaggaacacattaattagttatgcctagataagaaaactggagagtcaactcaagtcagctttccaaatcagtcatccaatccgaatgcttctaaaataatgaacaattaaaagtaatttcacactggttctcagttctagctgcacgttagagttacctaggcatcttcctaaagcactggggtctaaaccccactgcagacaaatgacacagtctctgtagggcaggtccaagaagagcatgggacgtacatttacgaaagatgatgaactactgcctcatcctcataggacctcagtcttcataagtagtgccaattcaatatggcaagaccacagtctctcccttaatctctacttttttttttcctgtctgagtaaatttactcaaagaaccagttcaaatattacctctaaaatgaaacatttatttatactcctaggaaaaattatttcttagcaaaagagttaaggaagccccgttgaggtattttgtacattgattttcctgtgattacatatgaggttacacagtcctcaagggtttgattgcattaaaatacatagcacctagcctaacgctcacaacatatcaagtcttgaatataggaaggaaggaaggaaggagagggagaaagaaatgaagaaaggaaggaggagagggagtaaaggaaggaaggaggaagggaggcagacagaagggaaaaaaggaagggagagaggggtggggagggagagaggtgggagaaaagaagaaagagggatggaagggagggagaaaaatgggcaggaggaagggtggggaagagggaggaaggaaggaaagaaagggaagagggagaaaggaaggaaagaatgggggcgagagaaaggaaggaagagggaagggagaaaggagggaaggaaagaaggaagagaagtagggagagggggagggaggagggagaagtaaaagaaggaaaggagggagggagagagagagagggaaggaaggaaggaaagaaggaaggaaggaaaaaagattcattaataagaatgattcaattagtttgcataccaggctgtgcctttggcagctgagggtgttcaggtaccagagacctaagagaaagggtacaaaaaggaaagatagaagtgccagggagactacttgtatgagggcttcagcagcatttttaacttaccatttgatgtttttagctttagaatactttcctcaaatatatataacagaaattagtagccttaagtgtggtcccctgaccaacagcatcttgggatttgttagaaatgcaaattctcacaacctgccccagacctaccacaccagcaactctggggttagggcccagcattctgattttgcaagcgtttccacgtgtttccgatgtgtcctcaagcttgagaaccgctggtgtagataaaagtcgacttactttggttgaaacacagctagtaaatagctgtcaattcctactccctttccatgcaaatacacacaaatacagtcctgtggagtctgtctccatagagtccccaagtcctcacacaacgaagttgaataagctggtcttgcaagtgtgagcctccctctatgttatacacagtctcagtgttgcctgactccagagttcccgtggttctccacatgtgaacttcaagaggaattatttctcttgatgacttttagattcagacttttgctaattcacacaatcccaaatctgatgattgccagaactttgtctgattaaaaaagaaaaagtcagttaaagcagttttcagtttggtatatgcagcctacccaactctgttcactttctaccaaacaatccttccctaatattgtaaccttcaagagtggtcccaaagccatccacacttctgtaggcaccattgacatagcatatgctgagcagattcccaagctgccatttcacccaatcatattttagacagttgaagtctttatttgagaagcattccgatctgagggttttttccctcgtctacttaaaatttcatagctgtgttaatttatcacccctcctcattgcgtagcttctgagtaagttatacagtaatggtgaatgataaatcagagggccaggcctatattactcatgacattgtaatagtattaatctgagatagcttttaattgtccgttctacagtctttaatgctaagaagatatagaggtttccattattctaattgtatttcaaataaatgtatgggctcaaatttttcctctctgttaaaaaaaaggctaaattagagatgtcttgcatataaaatgaattattttacagcaaaactttgattaatcacactgaaaaatagcagaaatctcaactgtatgtatgttgtctgcacttagtttgtcagaaaatgacaaaaagggtcagaaaataaggtttcatcgtgaaattaaaaaacgaaatttcaaaaaactttcaaagcaaccccctatgcctttcatatctgtaatctagttaagtgaaaatggatgttcagataacctgtggtccttttagctatcaagcaaaaagtggattattttcaaaggcttcatttgcaagataagaaatggattaatgcattttcaaagtactttcaacaagactattgagacaaattaggttaattttgaagttattgaaaagaccactttccaagtattccagtcaatcaaactttaattacagtaactacatatattgatcatacttagaagaaaaaggcagttacccagaaaagtgaaatttcctggtaattgatgctttccatatgaagcaccaaaacatttggatatgaactattgtggttgtagttaaaccatttgcagtctgactaaacagagaacagtgactgtctttagatattcctcatggcatttgtatcagttggcatcattcatacgagcacagtgaataaagcaggaactggtctataaagcattcttatctttcagacagtggaactcagtatatttactttcttctacattaaggagtccaagacgggtgctgtaaatcttttttttttttcttttaataaactctttagttttatcttcccctcctgctgtctcttggtggccactgctaaactaaggtctctagcaagaatttctatggagttctttgggtccatgtctgaaagtggccctctgtctatcttacttcacaaccagaaggttgtggggacaaggcaagtactttggaccagaaaagcagatcacagaagatttataagtgtttaggcagcagtaggtcagatgccagaggaataaattgagatcaagagtgcaaaatgagaattcccaagtatatgcgattagacagagcctggaaaattgccaggaactggtgggggtgggcagtgatgggggtgggtcagcacaagatgatgtccaagtgccaggccaaatagcaagtaagagatctctggaaattgaagcagacggacaaatttgaaataaaataaaataaacagaatttggaatcagttatatggaaaagacacagagaagcaattgatattttagcttcaatatttcttacttcttaaatcgtcaagtcacccacttctcaccacctgcaccattaccaccctaatctgagctatcatatctcttccataaacgctaatcctgtagaagtccctccagctggtctccacaggcaggcgatgccattgctggcccacccagatcctctttaccaggcaggtgcgtccatcccccagcagctatgagcattggctgctaatagtccccagcagctatgagcattggctgctaatagtccccagtggcatccttcctctgagaaccgtcctagcatataggaaaatacctgggagagtagcgcaccctccctttggcgtgcatcccccagccaattaattaacagaaatccaaaggctggctcctcaacttgaggtgagataaacctgtggtaccatgcagactccaggtatacctgtaggatcaggtacagtgaaaacagatgtcagttaaagcaggtcttcattgaacaaacttctaacctggaagtacaagtatttcattttcctcaattccttactgttttttatctatatattaaatatatatatatatattttcctaggccctctcccacttggacaagtacctatctctcaaaccctgcttctgggaagccttatataagatgcactgtcttcacatttgctgccctgtagcataagtaaatacagttatttaacttaggataatgccatatgatttgccaaaattgtattttgaattttgttctagacagaagaaattttatatcattaagatgagtgaaattcctattaaaaaggataaaagcgcaactcgatttctgacttcataaagattgaatattgtttcttactcattctacttggaaatagtcaagaaactctctgaaagtagaatatttcaaaaaattctgagaaaattaagatatttagaaacaaaaaggatagctgttttgaaaaataagtaaagtaagggaaatcaaaaaatttttcttgactactttgactttactgggtatatcacatacattaatagattctgatagcacttcagttttttgttgttttctccgtgttgcagctaaaacattggggctcagttgacttaagaaatttgcccaatgtcgtataactagccagttttaagtttgtcctaaggtatctgactccaaaccctttgtgcttttctttctgccagtgtacagtattccaatgagtgctaattaagcatttaaatagcaagaaaagcaaataaaaaaaagatggcgtactttcagtaatttaagtaaatctgggaaatactatatattatatccctgttgggagataattctccctggatctcatatgtttctataaagtctgagtcttatgagcaaaagcatttatagtcaatttaagactgtataaggaggcattccagaatagtagaggcacttttctcccctcttaaagagactcgctcgtatgcttgtattcctgggtactacagataatatctctctctgtagggcaagatagatgggtttgctagctgtgttgtaataagattgggaatttcctaagctcagtgttctcagatgtaacctagacccctttgtgcacagcatcctttgggtcctctgcatatcacccccaggggacttgaggagcagcggggaaccagtgaaagcgcagagctcaggatgcctcctgtgatgaaaataacaaactgtctaaatctatttgagctcactggctccttaccagccaaatctgtggaagtatggaaaccactgcagacacttcccaccatattactgctaagaaactgctttaccatttgacaatcctcctcctaggaattccaaattccaagtgagggctctgagaagacttcagataaggaaacccattgatttttcattttacctaatgtaacttgttttcctctcttggatattaataggaaatgcagctccacagagacagaaagccaggcagccaagccagtgtggggtctctgaaataacactgtgctagctgctactttccctgtctcatttgaagattcactctcccccgtctaagcacacccagaagaaattcatgaagcagatgctacgcctctgagtcactgcttttatttgcttctcctgtatccaccaccttcttagctttaattacatggtttggcacattcttaaggtaaggataaattcataacagagattttctcctcttaaagagcagctctggaggaagccttaagcattagatcaagaatccacttagatgtctatgcctcttctacatcttttcttctgcttactctaattgctatgcagtcctatctaacctctaaaagagtctgactttcttctccctcctgttgcattgcttgatataatggtataaacaactaagaagctgaaataatatgatgtgaactttcctaaaagccagtctgagaattctgcaataggagctactaagtaataaaaaagaactcagctggaaatatactttgaaaaaataaattggaagatggctttaaatgcttttgagtagtcccatggaatataaaaggaagcagaacacagaaaatgataaacaaaactttcaagactgactcaataagtagctcttaaaatagctatgagtttccctcctaacacccagcaggctgccaataaccagacagacaaatcgaacaattaaatgctatgaggcagcatcagaaaagatccataacaacattctgagcagagccttaaccactgcctgaataaaatggtcccaggcacaagaggttgtttctgacctggacaaaacagtgaaaaggctgtgaaatgtattcttttactgagcatctgtgatgtgactgataatctaatgtgttctgggaatgttgagataagagacacagactttttcaaaatgtagggaaggaaacagatgagtaaaatagtcaataaaatatggtccagtaaggttatgatatatatatgtcatatgtcattgggagattgggggaaaaacacttcactcagatgtggggtgtttgaagggctgagtcctcagatgagactttctaggtgaggataaattttccaggttaaaaaaagatcagcaaatagagattctaggaggacgtggtgtgttcaagggcatcaagccatgaaagggctggtgctttgggagataccgcaggccagtctggctggagtgctgaaaacatgtgaggacagattgtgaaatgactctggagcttgaaaagaggtaaaatcatgaaaggccttttgtgtcacgctaagggacttggatttcatcctgagagtgaagaagaaaccactgacacgatttatagtcaggtctcactctttttctttttcctcttatggccttcagcgggcgctaacactggttggcagaatggccaattcataatttatagatcaaagtatgtacttctcacaaaatgaattcaaaagtgattaactttttcaatatactgtgttatcacatcctgacttaatttgtttttctcctggtttaaagtatgtttctggatgtacaaagtaaatctttgcattttacaaagatttttttttaaagccaatataaggagacttcgtggtctattatatatgataataagttccaattggaaagaatctggtagtgttaataaagaatccttaaaaccaaagaagggaccatgtttaatgggaacatttataatgcacatatcccagtagcaattagaatgggggagggagaatcagcaacagatccatgagaatttggcatatgtggcctctagctttacataggctgatagattttcagtcaagcttgaatatggaagtcttgaaaactctttcctccatcctctgtttcctagagattactctttcaagtgatctcatcattgtcagcctctctgataagatcctagaccctggctgcagtttgactccagagtactctttcctttatattatctccacagacctggctcttttgcagaaagaaatttttaaatttgggacactgaaaagagcacatcaaatactgaaaactgtttcatgaggatcaaaagcttgctctctttatgcagctacttttggtaaatactgcttaaatagttactaggaagtcttcaactgtattactaaatgatattgcagtgaacatcaaaaatgggaggatagttcatttaatctgaaaagctgcatatttttatattatgtatactgcagtgcttgacatagctcactgtttttcatttccttgcaactgctggcctcttaaattgccttttttttttttttttatcatgtttctgttacattcaggctctttcttgctgagttattttgaaaaaaaaaagaaaaaacagttttgatctcaaaggtactgatattaagatttatccatacaattaaaaaattttaaatgtaggcctagaaagacattagaattgttccagactttttatagcatcaaatttcctcaagtctctaccattgcttaaatttgtcacccagctaatgtgtatgaggtcagtaaaatggaagtactggcatttctatttgatgaaaagttctatttaattaattatatttgtccccatgaagcctaataatgcatcaagattgaaaaaaattatatgtatacaaatatataaagaagataaatttataatatttattttgggttagaacacaatgttgccccatataaataacattttgatgtgttaagaaagaaagaaaacaacagttaaataaaccaccagttagattgagtgggaaagtgtttccttcctatacctacctatgcatttaatattttggcttaaatttgcaatttatgaatgcaattttagagaaggaaaaaacttcatttatactgagtatggtaagaatgttgtggggaaaattctagttattgtgaccttgaggggttaggctattgtaatatgccacatattacatatgccactctgtgtacagtgtagcagtagaattccagcttttgaatgaacatggtttcaaatgattggtccatattggggccatcatttcaatcaggaattaccagctctgtatattccaaaggttatgagggggcctgtaacatggcacattttcattttttcttctgattcttattctttcagaagtagctaccttttgaccattatcaatttttaaaaattgtactttgcacgtttaatccatttttaaccatacaataattacactcgtgtggtggtaaaattatgtgtcgttggggaatgcatataaaaacttgatgttaaacataccatagattcactcaattttttgatgggaaattttctgagcaaaagctgtctaaaaatggttctgatatatcccaaagaggttatgaattgcatcatttacctaattaatttattcactcttgctcattcattctgtaagtgagcattatgtgaacaaagaggcactactagggcacaagtacaacaaatacgagagatggagccacgagcatatgcttcaggcattgtggccgaggacaggcttcaaaagacactcctactacagtcggaaaaatctgagatcaattataagtaacatgcattgtattttagaacttttctgatatttcaaaagagaaaagaaattttccaacggcctaaacacacaataattagctaaaacttaaaataataatataatatcgaacaatttggaaattccagcttactgtggtgcatttattgctatcagtgctgagactgggaagctaacttgggaacttcattgaaaatattggaaatgaaactgagactcttacatttgattcagatctacaaaggctaggatagtttcatgtcagtaacaacctctggctccaagcataagtaataaaaaaatcctaactggaggaaatcttattcttttttgcctctcaggggtcatacagattaaactcaatcaaatgtgagttcacattaaaactcaaagcaataaatgtaatatgtaaaccaccatgagtgagtgtttgcagaaataagaaacgtatttagactctcaaggacttaagaaattaaaattattatatacagaatataaaataatatatgaaaagatcaaagaaataaaagctaaaacacaaaaatgagcatggaataaaaaattattttaaataattaaacagatttggaaaagacctaaatggaactctcagaaaccatcatcactgaaactaaaaattctatgagttactgcactcccatttcatcagctaaaataaaaaataaaaataataccaaacgttttgcaaggattaagagaccctggatttcttagacatttctggtgggaatttaaaatgatacagctactctggaaaaaagtcttcatcttcttgtaaaattaaatatgcaattactatttgaaacccagcaatcacattcttggacatttattccagagaaatgaacttttattcacacaaaaacctgcctcctaacatttatagcatttttttttactggaaacaacccaaatatcctccagtgggtgaatggttaacaggttccaatgcattcacacaatggaatactactcagcaataaaaaggaacaaacttttgctataagcaataacctggatggattgtaagagctttacacttagtgaaaaagtcaaatttcaaaatattacaaattgtataatttcatttatgtaacactcttgaaataacaataatataaaaacctgtagatatggagaacaaattaatagttgccaggggggcagagataggggtaggatttgaatataggtagagttctttcctatgatgacactgttctgcatcctgattgcagtggtagtaacatgaatgaagttaggctgaaactgcatagcaccacagacacacacacacgcacacacatacacacacgagagagagagagaaatggactcaggtaaaaatggtgaacagtgaataatgtcagttatctatttaacagtgtgcaaatgtcaatttcctagagcgaaactagtgaaaatttcatgggactctgagtacttttgttgcaacttcccatggatctaaaactacatcaaaactagaaaaaaaaaaaaaaaaagcttaaagctaaaattaaaaaacaacaacaacacaccgaagtatcaagaccatagttagacagccaatgctcaggtaggataaaagcaaaaaaaaaaaaaaaaaaaaaaagttttaaactgaaagagtgaaagatagatttgaaggaaatagccaaaaataaagatatataatatatatatataaatatataatatagaaatatataatatgaaagtggtgctaagagacacgaatgatagaataaaaaggtctaacatagacctaattgatgaatggaggagaggcgaaattttaaaaaatagtaatttatagtaccaaaaaatgatgaatgatatgaatccacagataggagtattaaaaggatgcccatgatgtagacatgttatagaaaaagtagaacaccaaaggaaagacagaaagggaaaatactaaaagcattcagagaaaagagagatcacataaaaagccaaatcatttagaccaagggttgctaaagagggctgcacatcataatttccatgaggttcttttgactatcaaatgccatactcaccccggtgaaatcatggtctttgggagtaggcctagacataagaacttttaatactcaccatgtgattccaggggttgagaaccattaatttagcttgtgagtaagcttttctagtaaataggcaagactaccagtggaatactatcttcaaagttctcagagaggccgagcatggtggctcatgcctgtaatcccaacactttgggataccgaggcaggcagatcacctgaggtcaggagtttgaaaccagccaggccaacatgatgaaacctgaaaccccatctctactaaacatagaaaaattagccgggcatggtggtgggtgcctgtaatcccagctacttgggaggctgaagcacaggaatctcttgaacccaggaggtggaggtggcagtgagccgagattgtgccactgcactccaggtcggacgacagaacaaggctctgtctcaaaaaaaaaaaaaaaaaaagttctcagagaaaaaaaaaaatcaatccagaattatataccaagcaaaatgagattgatataaagacattttctggtagataaaagcagagattgtatcacaaaagacttccaccaaaggaatttctaaaggatatattccaaaaggagaaaaatgagattcccaggatgtttgatagttaaatgagaatggtgagtaaagaaattggcaagtgtgtaagcaaatataacaggcattatccttaagaataaatgatcacgacaacaataataatctctgtgtgaggtttagaaatgaatatatgctgaataatgtttcatgtaagtcagaggtggatcagtgttaaagtgttttaaagtactcaaatcatctggatttgaagttggttctctaattttaagggctcgtgttattagattggatcctcctggataagtcaggatactttccccatctcaagggtcgtacccttaatcacatcggcaaagtcctttttgcagtgtcacattttccaggtatctggatgtggatatatttgggagctattattctgcctaccacagggccacctgtcagaaagagagggtcaaattacagaacacaggataatgcaagtgttcccaggatctgtcttaaaggactccaaaatgggcaaggtcgttgtacattcaatatttgataaaatattgaatgttccatattttcatattcagataaatttcactttgtctgaatcagattagtggtagggcaggggctatgagatgatagtggaaatcacatttcagatcctgaatggcattataaggcactttagaagttgacatttattcccaagggcaatggggaacctcttacatatttttatgtatcaagaggaagactaaattaagagtggaatagtagggtcatctctctgcttgctgcttagagaatgcattgacagcataaatctagaggacggaattaagaaatacagtttgaagttttagagtagattaaatgaatgaaggaatcacctgaagaggcacagtggtgtggccgataaaacccaggaatcagaatacttggcttggattagtggctgttttgcagtggatgttgcttgataactgtttgaattctctgagctggtggttaactgttggcaacttgtcatcaactacagggggagtatttgtaccggaaaatctgcaaatgctctcccactcttcccccagagccagaagcctccgcaagctagtggtggtgtgatattgaaaaaaataaaaccctcaaatcctccatcctcgatacagggaagctagcatcagtgaggctcacttcataaggttgttttaaggttcaaaatgaaaataggtagtatgcatgaggaagcaaggtgatgagaagttgctgaattttgttttgatgcttttgccaagtattgttactagtagggttctataaacagaacctaagtcaaattacctgtttaacaattttcagtaggtcaaatgtgctctcattactagagtatgattcacttggattattacaaatagaaatgtaaatacctatgtaaaagaacatatattcctcatatgcaagtgtatacatatacgtccaggcatgcacacaacacacacacatacacacatacacagggagttaaggtgacatacaaatgtctttttatctttcaagtttatacccaaagacattggaaaagggagacagatgaagatgagaatgtcagtgtcattttcctgaactcattggaaaattaggttttagctctttggccaaaggtgtttgctgactccacgcctgacacagaccgaaacactaactgatctcaatttcaggcaatgctagaaaaccacagttctccccaacatgaacaaagcctaatcccatgtgcacagcaggatggttttaaaagatgccattttgttgttgttgttgttagcaagctgattctaaaagacaaagagaaaaaatagagtaccaaaatacccatgcagggtttcttcccctaaaggcagcagttgtatgggaagcattcctgcctctctggggaagagtgagcccggaagagggatcagggttctaattccatggttcagtgctagctaaggggacctcatacctctagaaggctcctagtaatagcgaaaagggaggatttatatgattgaagagaagaacaataacaacagtactgtggtactattaatttatttttaggaattacattacttttttacattactgtaggaatccatatacatgctagtagtaatacttcaactagatggaaacatgagaaatggggacattcacacaatggtggtaagagagtgaatggatcccaacttttgcaaaataaaaatagcaccgtgccgtaaaaccaaaaatgtgctttctcctttatttagtaatctcagttataggagcttaatttatatttaaagagcaaataaacactaaaggaagacatgatacttgcacatttgtataactggggtggagggagcacatgggctacaaaatgtagaaaaatcttatacatcaagcataattttggccttgaacagtaatgccattgtttagctctgaatttcttttataccttgagtcccgctatagaatttttgctattgttctttcatctgtaggtcccttctctacaaggaataatcaggattccaggaactactcatatactcaaaatttttgaaatgagttttatgtcttggccacatctccttgatatccttcagcaagaaatatgtggttataaaatcaaatgggaaaaaacgactgcaatggtggaaaaggttttattgtcagatacactaaaacactttggatatgaatgttatgtttaattgatataaaagtctaaacacttacccactgtgctgtgattatggccagggtcattcttcagagctaattcatttagaatatgttaagaaaaatcctgtaagcatcagtaattgaggaaaattgaactcttgaacttttgccagatatttggctgtatgcattttatgtgttaactgagaagaagctgacaacttgctacattctgaaatcgtctcagttgagatttgggttgcaggagacattagccattagcccaactgcagggctattcactgtggccgtatcataccagtgctcaggagacagcagtcacacctaagaagtatgtccttcctcacctggactgctctcatagcaaagccacctgaacatccctcgttgttttaccaaccagattcatcatctgcttcctgattcggcaacgagcatcacctgttacctgagggagtccatccttgtaagaataagaaacttgactaagcaaagttagcatgtggttgcgtcttcaaagagcacaaacgatcttgtgaaggcgattgtttggataccaagaaagataaagatctctttctatctttagtgatagcacccataggtgaatagaaggaaggaggctccgtcttagccgggaggaaactcacttgttcaacatcactggaacttctaagttgaagtggaaaagggagcatgtgattttcaacacttccaacacttccaagagtagcatgtttccatagtcatgcataatctcagtctgatttgaggctaagaaaatattaaaagtttccaactcttaaaaagtataggagtcccacggcctggacacatagtaaaacacttaataaacactttagatttttttttccaaggaagcagattacgtcttgaaacaccctttactctcaggccagtatggtacggtcagtaagaggtatcaagtaaaattaattattgaagaaaattcttcattctagagtctaaataatttctcctgagataatctttttccacagttattttattataatgggattaccctaatagtctttgctaaaagagctgagatacataaaattattttttcatagtatagagttctaaatctttatgtccttattttatttattaatattattattaatattattatttttggaaagagagtctcactgtgttttccaggctggagtgcagtggcataatctcggctcactgcaacctctgcctcccagattcaagctattctcctgcctcagcccaccgagtagctgggactacaggtatgcaccaccatgcctcgctaattgttttgcatttttagtagagatggggtctcaccatgttgaccaggctggtctcgaactcctgacctcatgcgatccacccactcggcctaccaaagtgctgggattacaggtgtgagccaccgcacccagccaccttttttattttctttaaaaatcaaaacagaacatatttgacttaggcctttatcagacagagagaaggatgcacatacctaagctggtaaataattatgtcatcctcatttacagtataggaactttctccgtaattattgtactttgaggattaattttccatatctcatgtgtgttccttaagatttccacctcataccttttttttttttcagctaaagcataaatgtattgactcaatctcagtttaagaagtagggtcaacagagccttaggaccatctcctggtggctaaccatgaattgtttcctttcatgatttttttaagcacatgttgagttagatgccaagattctgaaaccagatggagctgactcaatgagcttccatttatgttccagcatgccagcattagctgggttccagcagatacttaagtaatgagatttgagcaacatcttccccaaagtattatcttctttagcctattgtagtttatgaaatttgggggattaaaatctggcttagagagagtaggtcacttcaattctcaaagccttcattttcttatctataaaatgaaaataacaaaacctacttcataaggtctagtaatgattacattagaacatctggtagaagaagccaggcaaagtgactacatgctgtgttatttcttttatgtgacattactgaaaagacaaaaccttaggaaaatattagatccatatttgccagtgattggtagtgggaacagcagactgactaaaaaggggcacaagggaaattcgaggagtgatatgctttttgtctatcttaattgttatggtagttacacaactatttacattgtcaaaactcatcacggacttttagtttatacaaattataactcagcaggcctgactttttaaatgaacactcatcacggacttttagtttatacaaattataactcaacagacctgactttttaaatgaacactcatcacggacttttagtttatacaaattataactcaacaggcctgactttttaaatgaacatatgtaatgggtttcacacacaatgcagactcaataaacaagccctgctcacaacttctctcaaaggagccaagcacaacaggtacttaaattaatgtcctttacattgaaaggtattatataaaaccaaagcaagcattttccatttttaacacatttctaaggcttttgcatttccataaagaaggcagtgatgactcatgatgtgattttaagaatctgaacttactaaggtcccttgaaagtaaccacaaaaaggctagatctaaaatatattaaaatccatatacaattaattgtagagtgattcatatagatacagtctctattttgtattgcttcttttttaaatagttatctgctagtgaacaaaaaaataaatatatactttttgatatttcaaatagatatcaaaaagtatatatttatagcttttgaagtataacttttaaactttatcaaatataaaagtatatattctatttgatatataggtatgtgtatgtatatatgtatatttatttgatatatatgtatttgaatagaaatagaaagtgaatactagtaacctgatggctaagaacgatcacatatttatatgtattcattcaacacatgcactgtgggttgtattctgtgccaggagatgaggatgcagggatgaataaatagtatttctgtcctcaagaagctcatactttatagtgatttagagacatgtatgatgaaattgacactctaatgtgagtctgaacaatttttaggcaagcaaatgctcttcatgcactacattccataaccaacctatgcacagcagtaagtggagtctttggggcttggtttttgttaccacgtttgttacagaatgccatatttggacctatgacaaaaaaaaaagtaatcttaagtcaggcttgcttattggagaataaaatagaatcatgaggtaggagatttggagggactctgttacagtcaaataattttattttaaggaaagcagatttactccttaacactatcttaaaatcaggagaaaatgtaagaaactttcataaaatatttaatatagtttcaaagttgtgagcgtatcactgttcagaagttaactgcaaaacagagatgactatatttgccataattatcaataatgatgtatatatatatatatactctatagttacactgggatgagcattaatggattggtaatgaatgaacaacagcaatgattcaacaacattagttggctaaagcttcacaagaataaggaaaacacagcaggaaccttatagaggtaagtgaagcatgaaattcagttacgtctttgacctaatagcattaggtcaaagcctttcaactttatctctttactaattatggaacgaaccctgtttaaactcttcataccatataattctctaagcaattcttagtggtagttattattattcacattttagcgatgagaaaattgaaatccagatagatcaagtgacttatctaagataacccaaccagtaagtggcagagatggaatttgacctcagccaatctgggtcctggtccccacccttgactctgtatgatacagtgttacaacaagagcatgggtagagatgcaattagaaggtaagaattatatctgcaaaatcttgattagtcctaacaataataatgtagtcactactgttaacccaacttgatgcaggctaatagctaaaggtcataaagtgtccaaagaaagatttagtagtaagtacaatatcccaggagaatctacctccagagtgcaagtcgttatactactcaagttgatatcttccaatgtaggtgtctaaaagccctttctagttctgaatttcactgattctaaaagggagtttgtggttagtatagctggtgggggtagacttacattgctgccaagtgcagaaatacactaaagccatgcacagcaactcaagggtcagcatttttgtcccacttctgggcatcctgaaaatcctttcttctttgagcttcctcaaaatcttgtataaactgggcttaaactaggtagatctcagctggagggaaagttctagcaggctgaggaagcctagaaagtttgcattctctaagcaatgttagcatgaactctttgtactcattacttcttagtatatggcagcagcttcagaaaggtgagtcaggaaacattcacattcccaacaattagaatgtcaccactctttgttcattcttttgaattatagtcaagaagtgtcttattaattcaacacaatgcataaatatatcttgagtatctccaatgaatcatgtactgttcaagcctctggcaatacaaacaataaaagacactcctacgtctcaaggaactatcactttgggtgacagagagagacatctaaacaaatatacttacaatgttggtaatacattcatggaggcacatgggaaggacccagaagcagaggaggttcactgtgcttggatgcagatagcaggagttaatatggaagaagtcaagaatgtcttcccagagatggtgaaaaacaaaatgagttttgaagatatgatgggaaaatacactgatttttagatatagctctagataaaaataaagagacaaagtgttacaggtaaaattagctgcagatacatcttagttgtcatgtagttgatccaattgagtgaacaattgaacaacaattagaacacaaacaaacctccatgatctgaggcctgctgaactctcttttctgacagcccttcccactgcacattggatatagaatgatgccatggcattccatgcatccatgcctttgaacacactatctcctctgcttgaatgacctttgctgcttatgtagaaggaaaaaacagttacattcatacctaaggttccagagcttccaagaccttgtcaaagaaaatagactcctagcttttctctactgaatgcaatctccgttatcaggccataagctccttaggagctagcgctagatctgagtgaacactgccagtagtgtgatgaatttggcttttataggctcaaaagaaatattgttaaatgtacaacattttttgagccatttgttaaatttttggcagcttgaagtcatctatggtgggagctgacaaacactacattaaaaaaagatcaaaaaatttgttggataaattacattagagtaatttttaaagtcacatattcaagttgtagtgatttaaattaaataaagttagtgcagattataagaattgatgagtattgaattgatgagtattggaaaaggggatgagtggagacacctctctgagcagtgtgagttttgaaaaggaaatcaaattattagagaagataatggtagccaaaaagactttctaaggatcagtgttctcataattaaaaaaaagaaggcataagaatttctgccaaacatactttttcaaaaataaaaaagatatatgaaaatgttttataaaccatgtagtacataactatataatatatacattatatagtgtatagttgcaattattggactaaaagcagttaatacaggctttacatatgttaagacttttattcagaagtaaatgaaatgtactctttgagaatgggtatattttattgttttttataaccatattctcatttatttttgaaactcttcttagaataagaaaagagtacaggaagaccaacaagtcacattcaaaccttataattctgcagcctaggaaacactgtcttgtgctggaaatggcttcctttcttcctggtccaacttttttgaactgcccatggattttgcactgtacaaatcacaatccttagaaatatattacccacatacatttctgaagagggttttcagggcccttttttgagtattacttttggatatattattcctactaaattatatttcttccagaaaaagttttgaaaagttggcaacctccctatttcagtccttcatattatgccacttgttacagtcataaacagcaaggaaagaaggaagtttgaccaaatgcaaatggctgggaagaagtagccctttcagagttgctgaatgtctcgtgtgaaaatgctttgtggctgagcttaagaaataaatataaagtagtatttaaatcctcatctcaaagcttctatcagtaatagatatgaagcccaaagcagtaaatgtttaaatgactactttacatctcttaaatgcagtgttatgtcctggctatatggtaatgacatcattaaacagaaatcctttgagccgcagaaccaagatgctttatagtaagttctatgaagttacatagtcaaagagttcactgttctttaagttagactcatatccgcaattttatgacaggttctgcttaaataattgtagggtagtggtaaagcatggactttagggtcaataatctgaagatctaaatttgaatttgtcgtgtctttcattagttagctgacattctggatttcagtttcaagacctttaaaatgggaataatagcaatcatcttaaacatgtccaagaaagagtgagacaattaaataaatacattactaagaagggctataaatgaaatgttattataggtattagcatcatcattatcattcattaccctaatcattatcatctttaagcaatattaagggatgacacttacagatagactgagtcttactctctgggtcaagaaggttatttcaaaatgcaagttactaaagtatattatatatgcaaaacatttggcttattaaaactcaagtgtcatggctcatagccgagacctgcactttcatataaatgtgatttgatcatatgtatcatattcaaaaatatctattagtcctataacgttagccacagtggctaatttctataatagcttcacattttagttacttaccaacataaatatttatttcttatttatgttacagtaaacttaagtttgcttgggtggaaggttgtctctttttcacgcaattatttagagttccaggcttcatccatctaatggctttgttaaagtctagagtcttggagtgtaccactgactccgttaatctgaccggcagataaaatagtaaagaaatcatggaagcttgcaaggaaagtacatgaaccaggcctggaagtggtatataccacttccatgaaaaatcctactggtttaaaatcggtcgcatgactgcacctaattgcaaaggaagccagaaaatgtagtccacctatatgctctgatggaagataaaatggatttgatgagtcttgccagcctctgccatagggttctagcatattacaataaattatgaatttaattgaccgaaagacaaagcgcaacttaatggtgtcacaatcccatgttagttataaaaaataatgtataatctattctcccctttatggttactgtaaaaattagtagcaccctagttaattcaatgccagaaagcagctgtcttgagagttcatggtcttaagctttacatgcctgggctctatttttggtccagtggagttggtacctctggggcctgagtaatcccgtgttgcagcagacagagttcctctgctgcagtcaggccttctcatcagtgtatacccctgtgaaacttccagactacacagaataacctggctttctctcctggatgtggatgtggacactaaatgctcttcatctgaacgaagaggtttgtgtttcataaagattaagctaactatgaggaaaaaacaggcaaccagactcttctgagattttctgtctgcatatagacatcaatataaacataggtatatgtttgttcagtatggcttttattattaacagaacaagagccagctccctgagagctacccaaggtcctaaaccacctctgatcaaagttatctcatatctagggtagcagaggactcctgatttttcagaggacctattcccgtcatatcttataaaatgtaatgattgacttcttacatacaagctgctaattttgatatggtctaagctgatatcagtttacgctgaggactttttcatatcccaacataacttgacctttcatcccatttgattgcatggtctgttcatgaccagccctgacctgtgataaccctcctttataatattctggtgttaaggatgcccaaccttgcgctaaagtaacctgatagacccagaaatgctgccagtacagctattttatcaggtgggatttagatatttatgcttctgtgatcatgtttatcaaaaattccaaaaacattttctcatgaggataacataagaaaggagggaaggggctgagcacggtggctcacgcctgtcatcccagcactttgggaggccaaggcgggcggatcacgaggtcaggagatcgagaccatcctggctaacatggtgaaaccccatctctactaaaaatacaaaaaataagccgggtgtggtggtggtcgcctgtagtcccagctactcgggaggctgaggcaggagaatggtgtgaacccgggaggcgtagcttgcagtgagccgagattgcaccactgcactccagcctgggtgacaaagcgagactgcgtctcaaaaaagaaaggagggaaaggagggaaggaaaagagggatgattgattttccctgccttactcacaggatcaaatatgataatgcagacaaaactgttgtgatgatatagagtatttttgtcatctaactcatctaactccatcaaataataggatagcttggttttgagaaaacaagtgacaaattatcatacttatttttctcatgaaatatccttcatgtgtgatctttatattctttggaaaatctaaaagacttacagttagtcaaagtaagcaccaacctaagttccaatctaatttcagaagtctgaatcattattttaattctttagggtactggaaggaatttaggttcaagatagctgtgaacaatgtgtttatatagtaaaacaagatttatttatttgttatcactaaattccatttaaattttacaatagctattattacaataacacactattaaattacaactgcatttatgtagatacaacattcctcaaaaatgttgtttggtatttaaagggcattattatgattatcagaaagaaattttgttaaattgcatttaagatatcttaaatgtttatctagttgattggttgatttattgacatgagtagaatattttaaattagtaggctacctagttaaattaatgaatttttatctttagtatcatgaatgaaaatgttgcacatgttgagaatgaatatgagacagtctttaagtcaagagcattacaatctgattgggaagattattctattgaatatcatttgtcagttactgtgaatagaatggtgaatgagacatttaatttgcatgtacttgtcatatctttcctactaggatataagcttcaagtttcagaagatgagaaatgtgtttaacatctccctctctctctttttgtacagctcttgattgtcacaaagtccgatgtgcttgtagttagcaaaaatagttggataagataaataaatgaatgaataaatacacaataacattttgtagagaggatgtaatagatcctaggaacttccatttaacctgtgaaatctctccacacatacagttcagaggcaaaatgttctggttttctaaatcctcgtgatcacatcactgttgtcagtttgccttaaagaaaaagttggaaaagctcatagaggctagttgcttttagctgtgaatctccaaatacttgaacatttcagaatgaagccaaacactgtttaaaatatcagcaagtggttatccatggatggtgggattcacggcttaatgtttgtttatgttttcatttatttattattcttttgcagaggggcacagatagatccattatttgtgacacatggtacaggcatttgaaaagattcattgatagcaacatcacagcaagtaatacagaagtccatattgtttttccatcaagagttatgctgaaactagcagagcttatgctatgaaaagccccctggtagagaacctcttcaccctaacagcctacatatgtgggaaagggaagcagggcatatctagatgagtatataattgggggagcatcttgagaaagacaatgatctttttcaaaagggccaagcctcgtgatctcagcctctggtatctgcctgttcttccaatgagttctctcaggtctgcagagctagctgcttgctcatttattgaaaaggactggaaggagcgtccagggccatctgcatttgtctctcctcacatgcatcttctaaattttccacaatcatcatgttcgtaataaaaacatataaggtgttttttgtttttacaaggtaaattaaattgtgtatgatattttttattctttaaatgtcgtacacaaatgcatcatcgcactttagccttaattggccaaccctgggtattatcctgactaacaatggaagaaattaaagaatcatgagtcttcaaagtcagcttttgaagccagcctcaacctacttaattacagttgtgcgtgtgtgtgcatgtacgttgcatattttttaatggaatcttcatactagtcatgagaatggatagtcttctatttttcttttaattttgcgtataaggagagatggagattatgatagaataaacaagttgctgaatgaaggacacacagttaagaagtgacttagtcttacctccagtgaaacctgtggaatatatatatatatatatggaatatatatacacatatatgtatactgaactttgcaacaatttacttgatttacatttggctcttttacaaaaagtcagagtgagaaagagaaaattccatagaattagaatattctaattctaatttatacaaactatcatgggtttatagcatctgaaggcacccatttgagtaggggggtgttacattgactaatattgacctatttctgagaagacatgaaagttaaagggtcaattgagtgttgttgttttcaagaccagtttagctcctcttttcattttatagtcacatttaggaattcatagcattcaaagccatgataaacagattatgcaaaagtaagtaagtggatagtgactatagttgcattttatgttaactgcatccttaaaataaacattagcatatcacagcttttctagagaataatttcagtgatttcaaattagcttgtttcagtaatttcacataatgcaacccacagagtgcagtgaaaagaacagagtgaggaccaccagacctcagcttaaaaacactcctcagctttttgttacaaaaagaggcaggtagtgtaattcttccttgtaatttctaccattcagtgcctatgtaataataaaatgagaaagaattgatagaatatgctaatccaaaaacataaaccattatctttataaggaaaattaaaatacagattagaaacaaaaaatatctctgaacaaagtcattaaaattaaaaactaatttaacaagggtttaaagatatgtaatgatatagtataaaagctaaattaaagtatctaaaagtaaacaagtgttgaaaagatctgtaactcacttattggaaatataaaactgcatcaaagcgaaaatagtgtaaatagctaatagaaaaaggaaaggtgcttaaagaaatgtaacctagaaacaaatgataaataaaatgacagcaaatatgcatcagaattaaaatacaaacaaaaatagttgaaattcgaaggtaactattttctgtactttccatctcttaacacattttcaccctctgtagggtcaaagacagaacagatataagaagagtgcgttaaaacaatttacctgttctcatagagacaggaaacagttattaaataactaaacatataaacataaaatatttgcattttatacttgttttatgtaacttaaactgtttcccatctgcctggcatggtggcgcacatctgtaattccagcactttgacaggccaagaagggcagatcatttgagcccaggagtttgagaccagcctggacaacatgacgaaaacccatctctaaaaatgcaaaaattagccgggtgaggtggcgcacacctgtgatcccagctacttggagggctgaggtgggaggattgcttgagcccaggaggtctaggctgcagtgagctgtgtttgcgtcactgcactccagtctgggtgacagaataagacgctctctctctctcctccctccccctatatatattccccatcctacctcttgctctagtcactgctgtagtgatcagtttttcccctagacagagcctccttttgtgctctgtaaatcctccaatgacccatttctgcctcctgccttggggtttctgtaaggctgtggcaagtaatgccagaaaaacctgacctgcgcatgtacaaccaaaaccagaagcacaagggagttaatgcctgtgaggctatccttgagcagtgggggttgggacctgatgtgaaaaatctgaaatatagtatatgcaggttcacagaagtcccattgggatcaagaacctcctgtagtgtcgactaacctgatcaaataacactattttggctttcttcccattcatttttgactccctcagctatcactcactttatagataaagttcagagttcaaacaagttatgtaacttactcaaggtcaccctatttgtaagaaacaacagcatctgtcctcaatgccttcctttagaactgaaggcacttaaaaatattttctacttttacctctttaaaaagaggtaggtttaaaaacctgccttctgttctttctccccattcagtgacttcaaggtatgcatgcccctgtctgatgtgaagatgtcactggcgactgcctattacataaaaccttctcaaatatgttcctataaaaaatattattccagagagcacatggttgatccaaacgggctaatctctaatgctggaattctaggtttctttgttcctgaaattggtcaagtcttttccccccaatatccataaccataatatgcagtttgtcactcagggaactccacacaggcacctatcacagtttcctggtaataaaaattaagaatatagttgctcccatcttgggttggtttcaagtacatcaatagaacaacttatagaactgtcatattttagagaaaattgcagaaagcagtgtttccagtcatttgctaactgagctagaaattataatggcatgccaaattagactgagctgtaaaaggaagatattcacattactcttctctgccctcacagtatgcataagacactgagaggcctgcaattcttattctcttaactaaacgtttttcaagtcttccccattctgggtgttgtattttgctccatttattttgccttgcatccagtcaccttgcagctgtaataacttgttggctctctagggaaagtggggttggagtcctttctggtcaccggatggttgaaggatgtgcacggctgaactgtttacccacacctcatccctcctcctgttctatttttgagaactgtgtgtttcataattttaataaaaatagagatcacactgtttatttggcagaggcgatgagaatagggcatgctttgctggattttttttttttcttgaaattttccttctcacactgctgcccggtctaaggtgagaagtggctgtttctatgtcttactgtcttaggtgtccctctgcctgctgtcacataagctgtttctggcagctctgcctgtgaccaattctgctgtctcctgctgggaggctgacacctaactggaccctttgttttccagagtggaaagaacctggtttatgcaggcaagaagatagtatcctgagaatgaaaagttagatactgtctttgagccatgtgaagtgcaaaaagacacaaacagtgaacagctcgttaaattaggaaatctaaaacacaggcctcaaatgagaagcatttgtgtccccaaatctcaactcctatgctcaggagtttcactgaagatttactgtagaggcaatgtagaggggccctgggagtttaacaatgaatataatgtagccccaccctggaaacagacagtctaagggggagctgaagactttgtacaatagattttaaattcagaatttattgtattttattaattagttttggggtctagttattccacgttaacctgtaaaagttgccttgaactataaagaggttaaataaacaactaagaggagtaacataaaatctgtattctggcagcaatggaaatgtggaagaaggtaatcacattttcttttcctgacctccagaccaagaagtaagatttaaaaatggcttgtttcagcacacacagccccgttttcattttcacctatctctggccttcttatgccaatacctcgtgcccagatactcctatttggagaacaagagcagcagcttaatcagataaaagtaatatttttcttcttctttctagcaaaacttagattctcatagagcagagtctctcagctgtgtattagggaagaaatcaactgattaagctaaattattctatagtgtgaatgactgatagaatttttgttctagaaacattagtgttttaaatataagccttcctttaactatttaccttaatgatttgtgtttggtgcaacttacttctttagaaggacacatattctcaaggactcctaaaaacacatctttgcaccctccagggtaggagaataatggatggagaaacattgctctgcctcagtgattttcgagaagcgagagaaaggtgtctgcccagatggtgaggcattttgaaatggagccatggtgtattttgaaaagaattacagcaatactgaagtgtaacatcgtgtgtagaaaatgaagcacagatatccacaattctacgatccagattctctaaagtaaaattttactttaaaaagtcattgtgaatatgtaaaaaatacagaaattatcaggtagaaaaatgtctcattaggagctcatccagaacctccaggtgttttaatcgtattaaaagtaatataaaccagtattgagcactgatctggttactggtaatttagttcatatcaaagtgaagtaaagcaaataagcaaaacaaccaaagcagtgtggtgttctggtcaaaaaagccacctgggccagcgctggctgggcctctggaaaattgggaatccatgggctctccatcattgtatagctgctgccctcaaccattctaatcacacaattggaacaatcccgacccctcccctggtgtccacggtgcttattccgcagcatattgagcctctctgtgccagacacggttttaggaactggggatacatcctcctctctctcatggggttcacatttgaaccacaggagacagacaaaaaggagtgtcagatgctgatacgcattgggaagaaaacttaagaaacagtgatgtcatagaaaatgactggggtagggtaggggattattttatttggctggtggttggagaactctgaagaggtaacatctgagcccaggttaaatgacaagtttccagccttgcaaatatcagaagaaagagcattcctggcagagagaacatcaagtgcaaaaccatgggggcaggaatgagtttagcctgttttagaaacggagagaaagccagtgtgaaccttggagtgtgaccctggagagacaggcaaaacgtggaagccatagagcttcctaatccctggttgggaaactcattttacttccaaatgcattggaaagccctggagaattttgagcagggaggtaagaacagtttatcatttttaagtataccttttataataagttaaatgctaataaaccaatgactgcttgaatattatttggattccttgagagaacacatggctaaagaacagacctgtcttgctgctctctaaagcaatgaagctgatggaaaactcagctttgctgttcagcacaccgtcaccatgccaccctttacgtgccttgagccaatgtgtgtatgtgcctctaagacttctgagaccaaaacctctctttctgcctacttagcatgcacaccacaattcctctgaagtgtctgggggctacccgctttgctgtgatcttcttttagtgtattttaatggattttagaagagtgttaaatctctgctttgtaaagccttattcctatcctcaaattatctaaattcattaccttcttgctataatagtttaattgagtataggatacaaagctaatttatttcacatttttgcttttaatagttttcacttttcttattgaaaaagtaattactgaattccaatacaataactggaaatgacttttctaataacacatattatcatgtcatcatcagaagaaaattctttgaagtaccctcaaggtagaaagccctccatatgtgttttctatgttcatatatacatatatgagtgcattttaatgatgtgctgatattctattattttgcatgtactataattaaattgaactatataaaaaatgactttttagatcatagataatcaaatacttgtttatggttcaatctaatgtaacaattttcctacattttaatattttgtttttaatttttaatatcgagaaatgccatttatactcatcctatgtttatctaaatatatgtatataaattatacttgcacactagcctagtaatttctttagaataaattctcagtagttgaattattgcacatggaaaagaacatgtacatttttttttttttccttgagacggagtctcactctgtcaccaggctggagtgcagtggcacaatctcagctcactgcaacttctgcctcctgagttcaagtgattctcctgcctcagcctcccgagtagctgggactacaggcgcccaccaccacgcccggctaattttttttgtatttttagtagagacggggtttcaccatgttggccaggagaacatgtacatttctaatgcatatatttccaaatttatcttaaacttgtttatacaatagtattataagtagtaatactggatatgattgttttaattttggccgatcttttaggtagagaaaaaaagtttactttcgtgtgcatttccttgacttaccaattaaagcacttgagcattttttataatatttttccaccacacctgtcccttcaatcttttttaacggcatcctctcacatgctgccattaattcatgtactgtgtttagcaagcaaagcattttcaggtgggggtcattcctgaggataataaagtggatgaagtaggttccatgggatgatgatatcaactccaagggttaaaaaggttcaccattatatctttggaaaattagcttgcagtttgagatttgctaaaagccagcccacaagatgaacttcaccaggctcttgtctaaatgcccatcagagacattctggaaatactgtttactgggttaaggcgttaagacatctgggttaagcgccatcactgggatagtttttctgaaaaacccaaaaacatttatgatcttctatacaaaagcaaaaacttaacaaatacatgctctcttaccagagtaacaggggaatatattttatgcctgactagagctttgcaaggttaaatagggaagaaagataaagaaaaagaacaagaactatttcccgagcaatatgagaaaacgctggcatgttggagtttagtcccatgaactcattcacagatggggccctctgtccctctctcataatcaagaaagtgatcaggaatggagaataaatgattgattctagaactgtggaggagttcacttctcagaatgcggtttctgagccagtagcatggcgtcaagatacaccccaggcctgctaattcagaatctgcattttaacaagatccccagggattcacatgcaccttagagtgtgacaagccctgatttagaagatactatttgcagagcctgaagtacgtgaggtatggaaagagagacgacagaaaaagaaatcaccaagtttcagccttctgataaataaatacattgattaataatatggtacacaaagggatggagatgggaagttaaataatgacccaaggcagtgtgatatacaacacatgagtgtgcagtcccaattccttgtgacacagagcaccagagaagaataaattccagtgagtcggattagtttgtctttgatccattcagaaatgttaaattaatgttcttgacattatgaaataaaacaacacatctcaagtgcttacaatgatgtttagcacatggtgtgcagacaaccaactttagctagtgttatggctgttattattgtcagcatctttgtcctttgtcaagtaattggactactaaaggaaacagtacatattagagaagaatattgtgctaataagtgtgaggtatgattatataaggccaccttaattactgcaagaaaaggaagagaaaaagttgtcactttaaaaagctcagcaacagaatatcccgcatcagcacttagtggatatgcttgccattaaagccatggtgtggaattcctgattactcagcttttgcaaattgaaagaataataaatagcacaaaaaggaaaatggttacttcttctaagatgtatagaaacaaacatctaattttcatgttatgcttgtttaattaggtaatttactgtaacatatatttatcagacaagagtacagataagatgaggctctttttccctttatatcatattatgagtattaatttatactgcacaaaggacttactgattcttttcatgcgcgtccgtgtgaagaggccaccaaacaggctttgtgtgagcaacatggctgtgtatttcacctgggtgcaggcgggctgagtccgaaaagagagtccgcaaagggagataaaggtggggccgttttataggatttgggtaggtaaaggaaaattacagtcaaagggggtttgttctctggcgggcaggagtgggggttcgcaaggtgctcagtgggggtgctttttgagccaggatgagccaggaaaagaactttcacaaggtactgtcatcagttaaggcaaggaccggccatttatacttcttttgtggtggaatgtcatcagttaaggtggggcagggcgtattcacttcttttgtgattcttcagttacttcaggccatctgggcgaatacgtgcaggtcacaggggatgcgatggcttggcttgggctcagaggcctgacaattctcacataatgatgttggtgattgagatttacaggcaaaagacaaaagtgtgactatagaatataagaaaaaaaagaaggggagaaagtatatatttaagaagaatgaagtgtaacactaagagacataaaaccactattctggtataaaatatagtagccaattccatattctgggagtaaagaaataaattcaaatgttaggtcataccaaacagcaaagaaggcttgtacatgtgacctaccctttctgggacttaatttctccatttctgaatagagaagccaggatcaaatacagatcacctgagaaacagtggagaagctcaatattgccatgttttgtttcaggcataggctttggagtcaggtcaactttcatctgctttgcccactgaactagcgctgtagacttgatcaaattaacttatttgcatattaataaacaaatgaatgctggaatgagtagaggaaatagtgctttgattaatttctagaaatctgcctgtctcactcaggagctgctgggtgtggaaaatgaagagaggaagtaagcgtagtgttgagttttcccaatttgtcgctcttctgaagctctctttttcacttttcgcttgggctttcacgtaaaagttggtttgaaaataagttttctctggaaaaaaaaaatcttatgtaagaagtcttcaaccttcttaaacatgacagccatccacctttattggggagaggtaggtgactgtagattgctgaatagacactgtggcttgtgttaatgactcatgaacatagttaacagggaacaaaaaggacagtgagtatttaagtggaagaaaacatcagaaacttgctactccattccaatatacataggaggtgggcatatttaatggaaaatgcaaacacgtttagcattatgactatgatttagaatgttaggaaacaatttctctgataaaatgctatatatctgtatattctaaatagttgtatcactgaatcagccttcgcacttttcttctagcatttgatggcacccaaccacgtcttcaagttgttatgcctgttttcatttctttatgagacacgaatgttggcaaaagaaattgacaattttaaattgacatagcctgtttccttggaattttagaaaattttaacctgtattgcgaattgagatttatctttggcttatatgttttttatcatagcctatgaaataaaatctattattattaatattatgaataaataaacagaaaatctttaagatagtgcatcggtgtgggaatataacgcatggagcaccatttgaacttgatgaatattagcaagtaacacaaaggttcataatggctgataatgcaggtggtaaaatgactcattttatgttatacataaggcacccctctgaagtatacccactttggaaagatacacacaatcgaattagctaagaaacctccaaatatctttctaggatttttcatctctagaaaaagtcagatattcctaagagggaaataagtagaactattctacaaaaaatagttaacacagcaggcctgagtcggatatcttcaagcctgcttgcaaggttggcccttggctgccatctgggaacatgtattttgagatagtccccatttttctctgataagaatgcctcattgcacctaaactgtttacacaaacaatattgtttaggctgaatacctactttcctctaggtatctagaattttggtagtcaaagttgggtggcaggggtgcctatgtgaccagccaccaataaaacacctgagctctcagctctaatgagcttccctagtagacaatattgtattcatgtcagaaatatttctggaacaattaagtgtgtcatatgcgatcccactgggagaggattcttagaagcttgtacctattttctttggacttcattccatgtgacttctccccttgctgattttgcttttcatcctttcactgtaataactcatagccatgaacaggactatcaaacttgggcttggtcttgtggaccaccaaggcaactgtattattgtgtgtgtgtgtgtgtgtgtgtgtgtgtgtgtgtgtgtgtttctattaatatcgttgtttatttgatgctcatattttcccagttttatcagtagaagcccctccaaggcagttcccatatccttttgacagattcccttaatttttttatgttatttgattttttaaaattatactttaagttctgggatacatgtgcagaacgtgaagccttgtcacataggtacacacgtgccatggtggttcactgcacccatcaacctgtcatctacattaggtatttctcctaatgctatccctcctctagtcccccacccccagacaagccccagtgcgtgatgttcccctccctgtgtccatgtgttctcattgttcaactcccacttatgagtgaggacatgtggtgtttggttttctgttctcgtgttagtttgctgagaatgatggtttccagttacatccatgtctctgcaaaggacatgaactcatccttttttatggctgtttttaaaatgttcacctaaaaaacagatattaatcaattgcccactgtgtatcagacagtgttctggttactggggatacagcagtgtttaaaacagaaaattcctctgccaaaactagaagatgtcatagttagtcttaatagaatgctataatgtcctaaatattgtttaggctcaaagcgcctactttggccatcggcaaattagaattatatcagcaaattaacaagatatcccctaaaatacccttgatgcatgcggagacttcctctatccatttcttataccatgttgaccccctcattctccctccccttggtgccaatttattatgaccacactatgtaatgttgcatgaattgttttgtaattactctctagtgcttcaagtgggtatatttcatcttcccagtaagtagagagcaaatacaatacctcttttatgggttattttcatcctaaggttgctcagtctggtgtcctgcagacaaagtgtgctttcaaacatttgataattttttaatgtatccaatgctctgaaactattgctgcatttctgtctttgagcatgacttttttttacctgatagccacaacaagttcatattatgttttacttttggattttcccaaaagagctatgactagaggatagcatttccacctggggctttgtctgacttgtccatgactggtaattacagtttttgtctagatgtgacttttggtccagtctctgagcctccagcaaaccatacatcttcgataagccatgatgcttagagaactcattgtttcaatcacacagccatgaaagagaaccaccgacatttgtctcaaatgaaaatggagccaaaattcataggcaaagtcactctcccacagatttcacagaacttagagattcagagaaagcgagggtgttccgttccattgtttttgcttgtttatattttccattgatccaaaaataattttagcctgagaagacaagggagatcagtgagtggcagagacattttgggggtgacgttctggcaagggaattcagactttgagaagctcatcaaaatgatttgggaaagttttgtacccaaattaacaggcaaagtgtgtctttgtcaataataggataatctatttttctactaatcaatacttgagcaaaaattatgatttcaagtactaccttattgttccagcaattctatgccattggttgagaaatgagatgcatccattttagagttgctcctacagaacaatcagtgctttcctgggttatatttataaacgcattctcagttctgtgtcaaaaatacagttttacattattttttcattcgcgttattaaacattatttaacctcagaatgatgaaatggattaataatatgtcaaggaatgatagtgtaagctctcagtacattgcgtgaggcacatatcactattaataatctagaattgtatggcagtcattaatacttttgttttaatcctgtgatgctgtcagattattttgtataccattcgtcttttactttcagggtcatgacttgaaattttttaaacttattctttacggtatattcaggtatttaaaagttcagtagaaatgggatggaaccgttaaaatgtagagctttcctctcttggataaggagacctttttccagaattctaagtgaactgctatggcatgatgaagactagcactctcaggccaggtgcagtggctcacgcctgcaatcccagcactttgggaggctgaggtggagagtttgagaccaacctagccaacatggtgaaaccccacctctactaaaaattaaaaaaaaaaaaaattagcctggcatggtggcaggcatctgtaatcccagccatttgggaggctgaggcaggagaatcgcttgaacctgggaggtggaggtttcagtgagccgagattgtgccattgcactccagcctgggcaacaagagtgaaacgtcatctctggggaaaaaaaaaaaaaggctagtgctctcaatgtgctgagtcttttgtccctgacttaatctaagtatagtgcaccgttctcaattcataagcacagttgacccttgaacaacagagttttgaactatgtgggcccacctatacgcagattttttttcaataaatatatttttaaatgtttagagatttgtgacaatttgaaaaaactcactgatgaaccacatagcctagaaatatcaaaaaataggaagaagttaggtatgtcatgaatgcataaaatgtatgtagatactagtctattttatcatttactaattaccataaaatatacacgaatctattataacaagttaaaaattatcaaaactcatggacacacacttacagaccatgcatggaaccattaacagtagagagaaatgtaaacaaacaggaagatgtaatactaaatcataactgcatacaattaagtagtatgtaactgtactactatagtaattttgtagccacctccagttgctattatggtgagttcaagtgttcctactgtccacttaaaactctgtgtgatgctaatcacctcctcctgagcagtttgtctctccagtaaattgcctagtacagtaaaaagcgatctctcacgattctcacttaattttcactgtatttagtgcaatacagtaaagcttgaataacaccatgagacccatgcaaagtgccactagtgatgctggaagtgctcccaagaagcagagaaatgtcatgacattacaagaaagagttgaatttcttggtatggactgtagattgaggtctgcagatggagttgccaccatttcagacagacaattcattttgtaaacaatgtcaacttatggtatcaataaatacagtactgtactgtaagtctattttttcttccttatgattttaacattttcttttcccttgcttactttattgtaataatatagtatataatatatatataacatacaaaatatgtgttagtcaactgttgatgttactggtaaggcttttggtcaacagtatgctattaatatttaagtttttaggaagttaaaagttgtactcagatttttgactgtgcaggaagggctggttcccctaacttccatgttatttagctgtatagcattatatgcttactgtacatattttgtatacttaccccaataggagcattttgcatgttccttttaggaaagttgtgttgactcataaccataaatggctgtttcctatgtgcaagtgatagattctcttgtgactatttctaacatggcagttcaaccaatttgactttaggtccagtgttttggccagctaaaaacaatgcctgtttaaatgtgtaactgaaggaccagagtctctgtgaagtcaccttctaaaaattaaccccttctcttggctgaaaattgtaatggagacagaaataggtagaggcttaggtggtttgatcatagaactctacttgaagagctacatagctcaacagtctagatacataagaggataaaagagaatgagaaacaaaaagcaagtcaagattagttttctatgacctcaccatgcccacaagaataccaaactggcaacagaacccagagctttccctgttttaaagttaattttaactttcaagattaatgtaaatctaggtagccaagagtctccatcctatgtccagaggaaccaagaccagaaagctgtttcagagttgaatatctgatatttagtgatgaggttgtccttgcttgagtgctggaccttagttatccctaagtttcttgtgaggcgtgtgatgtattgacaagaacttaaagatttggtcatcagggtttctaggtctaaacatgagttctaccgtttactccctgggtgatcttgggcaaggtgctgaactactgtaagcctcaattctactttttaaatgacagtcagcattaccagataacgttggagcattaacaagaatatctgtgtcaaaaagtaaggaagtagtcaataaataagtaaataggtgaggataatagtatggcaaaggggcaccagaatttctcaacaaccaatgtttgaacaactagagcagcaaaataaataacacagttctagattataatctgaagtataaatatacatgaggccatactgatgtaaagaaatgacttcataaataaatacataaaataaaagtgtcaagtcatgcttacaaggaagattccaaacaacagcgtaggtagattctgtcccctccagtacccaggagatgcgatataattcctgtgttcctttcttaacattgactggggcatgcacttagtgactcgttgtcaaagaatatagtaagaaagggggagaaagggtatttttatcgtggagaaactaggtaaatactaccttaaccaaaccaataaggattaacatctccagcatgttatgtggatatcatgggctccttgtcattctgtgaacttcccctttgagatagtctcccataacctataattccagtctaatcataagaaaaacgacagacaaacataaattgacagtctacaaagtatctaaccagtattcctcaatctgtcaaggtcccgaaaccactgaaggccagccaagtctaagtaaacatgataagaaagtgccaggtggtatccaggatggagtcccaggatgggccaaggggtggggtggggagcattcatggaaaaattagtgaaatatgaggaacacctgaagtttaaagtaatgggtcagtgttggttcttagttttgataaatgtgtcatggtaatgtaaaatgttaacattaggaaaaatcagaaggtggtatactagaaatcactgtactatttttacatcttttctgtaaatctaaagtaatcatacaatttaaaagtttattagagaagaagaataagaattggacttgtaactaaggggtgtgttgcccagtaagtgacagaaaaaaaaatcaatttgtttattcttctttttcttacccatactgagaataagggctctcaggcactgaaggctgcacatcttatgattgcatctgcatgaaggtcaataataagcagagctaaagtgcagtgctggaagccaggagggcaggcacccttaaagggcatgacagtgacaggggtgggggcacgaggaggagaatgctaaggttatagacatgccctgtttcttgctctggattctggttacatagatgtggtcacctcgtcgaaattcatcttactggaaaattaatatttcttcacttttccatttttgtgttatacttaaatttacaaaaaaataaaaaagtttatattatggggctgggcatggttgctcacgcctgtaatcccagcactttgggaggccgaggagggtggatcacctgaggtcaggagtttgagaccagcctggtcaacatggtgaaaccccgtctctactagaaatacaaaaaatagccaggcatggtggtgcacacctacaatcccagctaatcgggaagctgggtcaagagaatcgcttgaacctgagaggcggaggttgcagtgagtcgagatcgtgccattgcactccagcctgggcaacaagagcgaaactccatctcaagagaaaaaaaattaaaaagtttatattaaagaataaatgtcagagataaatggagagtacagggttgcagttcatttgaggattgcattatctctccttcctaaagttcaatttgtgtctcaactgactgcatcaaaactaaccccaacgtcttttcaaggtcatctataacacacacaatgcatgctgctcttcaagtcctaagagaaaacagaattagtagggctgccttctcattcacaggatcataccttaactattcagaaattgacagttcattgtgatcaccaccaggtgtacagtatttagactaaacagacagtaaagatacaattccaaaagcttcatgataattccattttcatgaatccatgtatgttttctttcaagtttcaattgtgtttaaattttaggctgggaaaaaatagagaaaagacatttgcctttttctgagcaatttaattatggaaagggggtactcattttttagcacaatctggttttatctgaggttcgtctgtgatcagtggcaagcaactagtttttgtttttacacagggaaaaatatggaagcagtttttgactcaaaggccctactcactttgagttggatgtcccctgagaaatacctaagaagtagctttaaaataaattggaaagcgaagtaggaaaaaggtaggggaaggaagaggagtgaatgaagagtcagcaaatgagcaggtttccatttgaaatttaaattggcagctggcactatttgaatcattcttcatttaatataatttgaatggggtagatgataatcttgcattttgagaaggcaaagcaaaaccttgaatatgaggaatgtacaaacctctgttattttgcacagctcagtttaacacacttcccttcactatgcttagaagaaaatgaggtgtaggtactttagttgtttatttcttgtcagcacaatgcataaatgatgtaagcgcaagattcgaaccacatggtatgtggctatacacgattaaatggaattattgaaacaaggggcaaaaagaaaaccttgaacttgtgattgagtgaaagggaaacatccataatgttgaaattaaggtgggattaaaagatagtcattaataacaaagttatcatgctagtagaggttgatcagttaggaacgatatgaggaaaagaaaacttaattaactacagaaatatgtaaattactttttatacattccagataatgtgttttatttttctagaacactgattttgtatacttattttaatcagcattctgaatacaaacatctcaaaaatacaaacacttcacatacgaggaatgctaaaattagactagaaaacagccacagaacaaagagaatagcacaaaagagtcttacaaggaagacattctgacagacccatgaaaatagacacagtgtcctagactggatgtattatatcatctcacatattagagaaggggactgattgttattgttcttctagagagaatgtgcattttgccagcctgatcagattttatcctcatgatgtttagaggtacatattgcttctccggttttatacatgaaataattgaagcttgaaaaagtaactttaggctcaggtagttatagaaaccatcagaatttgaacccaggtcttatgtgatcctgaagctactgcccttggttaacattttgcagacatctccattttcctcagtgacaaccaaggaaatcatatgtattagaaaaatctcagggaaattttagatatatttagaagcatgaggaaaaaaatgggaattaaaaaaaaaaaaatcacatctttacgaaaggtacagaagaatgggccgggcacggtggctcacgcctgtaatcccagcactttgggaggccgaggagggcagatcacgaggtcaggagatcgagaccatcctgactaacacggtaaaaccccgtctctactaaaaatacaaaaaattagccgggtgtggtggagggcgcctgtagtcccagctactcgggaggctgaggcaggagaatggcgtgaacccaggaggcagagattgcggtgagccgagattgtgccactgcactccagcctgggtgacagaacgagactctgtatcaaaaaaaaaaaaaaaaagaaaaaaagaaagaaagaaaggtacagaagatagaagaaaataaaacaaatgatgaatgattctaggaggtgtaactgattctaaaggagttggaaactacaggcagtgacatccggaccccaactccccttcaagagcacctctggggtgtaaaggggaaaacagacttgggaattaacctacttggggtttggagtctggctctataaaactatttgtgtgactgcctgcaacctctttgtgtttctgtttgttaatttatgaagtaggaaggataacgtctgcatcattgaagtttattgtgaatattaagttagatgatacaaataaagaactgaatatacctagaatccattaagctctcggatgttagttccttcctcatttcataatatttctcttcagtagaatacagaaaagggcccacaagggatggatgttatttgctctgcctatgataagaaagaattttagagtcttgccaattattcggcctcatgtggatcaagcacatagatattaggtctattcttttccttttttttctgtccagatgcttggattcatgtacatgaaactgcttgttgcataaggaccaaagactgaaatattaataatggaattgcattttcatgtggactcaacttatcagttcccaaatttctaccttgctgtgcgaacagagaacatgtggaaacgtctctaggtgtctgcagttcactcagtttctctaattctaattattaatatggcattagacatagaagagttaagaagctcaagaatcagtctaggattacttgcttgtcatttaatgtgtcagcctggtaaagacaaatattttatgtaaattcaacaagaagtaaaagaatataaattatctagtggccaatagcttaaatacataacctgggaatataatcagccatgagattcaggaagggtgtttcacagttgtgcataatttataatgagagggcaggtataaatataggtaataagggatgaaggtatttatacttttaaaatatttaaatgtagtttgattacatccccaaataactttttctgccctgtcatctggtgtaactaaatatagcctggcattctggtagatcggagatgtatcttctctgtggataattagcctcttgtattaaaaataaaacctataaatatcacttcattagtaggattctatcctcttccctgctctctttatgatctggaataacccacagacatttagaagtctaatggccagaacgaaataaccgaggttggttttcggggctgttgagtgttgtgggtcaataatgaaaacggactgctcctaggttttagatcaacgagctctcaagggaaataaatgaaatgaagagaccatgggagtcaggaatttgctagttgcctcatttccactttttgtatattcttcttagttttccttgtacattaaatcattatgctctcaccaaggagagaatgataagtacctgattcataagatcttcttttctaagtaagttcctaattttttcaagggtaaataataataattcaattcttcagttcttctaagcatcatctatcatgagttcaaatatggtcacattaacataaatgttcaaactatgatagctcttaaccattgaggaacttaacttttcccctggatttttttcaggagtcactgaatgaaatgagatggctgtgtccccacccaaatctcaacttgaattttatctcccagaattcctacgtgttgtacgagggactcacggggaggtacttgaatcatggtggccggtctttcccatgctattctcatgatagtgaataagtctcagagatccgatggatttatcaggggtttccacctttgcttcttccttattttctcttgtcaccaccatgtaagaagtgcctttcacctaccaccatgattctgagacctccccagccatgtggaattgtaagttcagttaaagttagtcctctatttcttccccatcttgggtatgtctttatcagcagcatgaatacagactaatacagtaaactggtaacagtagagtggggcattgcttaaaagatacccaaaaatgtggaagcaactttggaacttgggtaagaggtagaggttggaccagattggagagctcagaagaagagagaaaaatgtgggaaattttggaacttcctagagacttgttgaatggctttgcccaaaatgctgatagtgatatggacaataaggtccaggctaaggtggtctcagatggagatgaggaatttgctgggaactggagcaaaagtgactcttgttatgttttagcaaagagactggtggtattttgcccctgccctagagatccatggaattttgaacttgagaaagatgatttagggcatctggctgaagaaatttctaagcagcaaaccattcaagaggtgacttgggtactgttaaaggcattcagtttataagggaagcacagcataaaagtttggaaattttgcagcctgattatgtggatagaaaagaaaaactcattttctggggagaaattcaagctggttgcagtaatttgcataagtagcaaggagcctaatgttaatccccaagaccatggggaaaatgtctccaggccatgtcagagatcttcacagcagcccttcccatcacaggcccggaggccctggaggaaaaagtggtcttatgggccgggtccagggtccccgcgctctgtgcagcctagggacttgttgctctgtgtcccacctgctccagccattgctgaaaggggccaatgtacagcttgggctgtaggggctgtggcttcagagggtggaagccccaagccttggcagcttccatgtggtgttgaggctgtgggggcacagaagtcaagaattgaggtttgggaacctctgcttagatttcagaagatgtatggaaatgcctggatgcccagataaaagtttattggaggggtagggcccttaaggagaacctctgctagggcagtgcagaagggaaatgtggggttggagaccccacacagagtccctactgggtcactgcctggtggagctgtgagaagaaagagggccaccatcctcccagaatggtagatccaccaacagcttgcactgtgcacctgaaaagccacagacactcaatgccagcctgggaaagcagccaggaggcaggcaaagccacaggggtggagctttccaagaccatgggaacccacctcttgcatcagcgtgacctggatgtgagacctggagtcaaatgagatcattttggagctttaaaatttgactgccctgctggatttcagacttgcacgggccctgtaacccctttattttggagaatttctcccatggaaacagctacatttacccaatacacataccccatcgtaactaggaattaacaagcttgcttttgattttataggctcataggcagaagggacttgccttgtctcagatgaaactttgcactctggacttttgggttaatgctgaaatgagttaagactttgcaggactgttgggaaggcatgattggttttgaaatgtggggacatgagatttggaggggccagggcggaatgatatagtttggctgcgtccccacccaaatctcaatttgaattgtatctcccagaattcccacatgttgtgggagggacccaggggcaggtaattgaatcatgggggctgatctttcccgtgctattctcataatagtgaataagtctcacgagatctgatgggtttatcaggggtttccactttggcttcttcattattttctcttgccgccatgaagtaagaagtgcctttcacctcctgccatgattctgaggcctctgcagccatgtggacctgtaagtccaattaaacctcattttcttcccagtctcagatatgtctttattggcagcattaaaacagactgatacacaaagaatgtacatttagtagttgcccttcatgaaaactcaagagcattgcttctcaagtgctaggcattctactaccttctcctttggacacacgagtgctcttcaggaagccgctcttgtgctgaaaggtcccagagcagtactgtgaactttggggcaatggaggaggtttgggcaacttctcctcttaactaagttgttcttggttacctgtcccctgcagcagatgcttggcccagacacatagaaaacctaatataaacaaacactttcagtacttaacgctagcccttctctcatatatcaactaggtctggctaagttatgctacccacaaatctcagtggcttaaaaccaaaaaaactttgttttgttttgttttgttttttctcccacaaagtgcctctcagggcttaacaaaggagctctgcttgtgggagacactcagagaccaaagtgagtggattagctctcacctcaaattctgctgcttcctatgccagagagaaaggaaactatttcaaggacaattaaatgcttgacctgaaagtgacacattgcactttcacttacaacttattggccataattatcatatgaccccacttaggggcagggaaggtccaggaagtacaattctatcatgtaccctcatggaggggaaactggagacttttggtggacacaacaatctctttgtgaaagggctcaaaacctggctgagtgagaaccattaaaagcctatcttttttattctccatgatttccaatcccctcccacctatgcccaggcacttctatgcagaccattcctcaggaaataaacaaaattatccatctcagggaattaattgatgcaaacagataccttcagagtttctttacttttcaaattcactagcaatctaatttggactcagctaagataccttacaataacatatttttatttttgaatgatgtcgacattacaagctattttacaggctgatttgattctcatgaaaatgtttgcaactgaagctagccatgtattattttccccatttgatattataaagctacatctcagaaagtttgaatggcttgcttaacactaccaagctagttaatggtaaaatttggtttacaattttagaatccaagcctaactattcttttcttactaaaccattttgatttattctcagaaaaaggaataaattgaactatacctcagaagatacagggaagtttgcttatttcttttcattatattgcttttttgtcgtaatacctgggaatgatatgtgtcaatgtgagtcaaagaacttgttcttagatcgttatgagttatcaggaaaatattaacttgtcttaataatctgagcaagttatcaccagacttttaattttacctatttcctaaccccaaaagcacatatcagaaaaatttggcatattacaataaaaccatatgctagttggtaatattgaaatgaataataatgtcagacaatagtgtcacaatccaaccatttgcttgagtcaaaaacttataatcttccttgattctccattttttttgttgtttattgaactctccagccctatctaacccaacaggaaatcccattctctcttcttccaaaatattttaaaaccaatctcctctcaccgtctgcacagctagtacaagccgacagcatccttcccattgagtacagaatcagtcgtgaaactaatttccctacttcctcagattcttgttggagtcattttttacccagcagacagaatgatcttttcttaaacattttttaagttacgtaacataatgcacatatgagaaagtgcataaaacataaatacactgcttaactaattgttgtaaggtgaacactctagtagctattatcaatgggctcaataaatagaacattatctttacctagaagcaggagggacaggtatttctgatcaaaatcattttttcttttgtacatgtaactgtgttgatattttattgatacataatagttgtatgtatttggggggtacgtcttacattttcataacagtatgcaatgtgtaatgatcaagtcagggtaattgggatatccatcacctcaaacatttattttgtccttttgttgggaacattacaattcttctcttccagctattttgaaatatacaataaatattttttaactataatttccctgctgtgctattgaatactagaacttacttctatgtaactgtatttttgttatggtaataacttccttatttggtttatatgtactcacaaataatataaattttctaacttcttttagaattttctattaaaaaattatatcattgtttattatttttgtatctaacttattttatgatatacgtatctatgttgctgtgtgtttctgcacatagttttgttgatatagttgttccagttctctgttgctatgtaacaaaccactcctaactggcacagaaagaactgttttattatgttcatagattctgtgggttgggaattcaaacaaagtatagcttggagatttgtctctgcttcataaagcctggggtatcacctgaagaggctcagatgtctggggactagaattacctggagtcttcctcatttacatgtccagcagctgggctaaggtgacgaagcaaacactacaaatcagtgtgcctgcaagtgtctattaacataacctgggcttccttaaagcgtggtggtgtcagaggagtcaaatttcttacaagtggctcaatactccaagagaaaacgtttcagcagcgctggacagaaacacatacccttttatgaacacacgtccttttatgaatgaggacacatgacatcattttcaccaaattttgatgattagacctgccacaatcccaaatgtattcaaatggtggatccatggatccagcatattttaaacaacaaaatagtattccactgtgttaatatactataatttaattattcattctgttcttaatagatatttgagttgcttccattttgaactattatgaacaatacttctgtaaacattctttggtgtgtattctggtataggtcagcatgcatttctgaaagaaatatacataggaatataattgctaagttttagagtatgcaatattcagctttatgagataccatcaaaaggtttatcaaagtgattataccaatttacactgcccccaaacataaaagtgggaacactcttgccaacacaaactgagattttcggaatctaactttttttttttttttttgcttaatgtcccttggaaattccaatagcacttgacataaaaatgaaaccgtttaccgtggcctacagggcttagatgacctggtctctgcacttctctgtggacttatcttcaccttgccataaggctgcagcctcatgagcctcctttctagccctaaaacaagacaaactcattccccacctgggacccttgtacctgctctttcctctcctggaaagcacacatcccccaagtccaatatctgttcctcaaggaggacttgtgtgaccaccaatataaaatgcattccactccccacccctagtttctccctttaatgctattctgttttcatcagatcacataagcaccacataaaattatcttttttatatgcttgtttatttatattgtgtctattacccctagaatttatagtgtcttgaaatgtgtaaaagactgctttttgaattaatgcatttttataattaattaagtaattgagtaaacttacctagctgtgtgataataggtgttatgttttttattcttcttatgcatttatttatgtcaagcacagtgcttgggactagtggatgttcagtaatattaataattgaaataatttggctcacattaatgttgaagtggaaagaaattttgtgtcctagattggccaagttttaagatgggttgatcactctgggctctgagagattagaaagaactatgtttactcctctgtaagaaggccatttagataacccacctgactgtcctcattatcaattttctcctttttatttatttggtttctttctattgtctgttcactcaccctttgatggataatgctcaggcatcttctgcaggttagcctgacactaaaatttaactctcatatttttgaagcttcgataaaagtagtcgatgctggaaaactgtctctgacacagtgagcagctctttgttttgcagtaagtggagtctttaaaaagattgtgatttttattgtccctttctttgtgacaatcgtgtgaaagggtcagttaattatgcaaatttggaacttctgagaggaagccaattgagaagcagtgaatgaagcaacccaatcaccctggaggcagagataccccgtcctcttacttggaggctgtctcagctcaactgagtgcagtgactctttacctgcatacggcttgcgaaacccactcagagtctattcaatggatctgcagcagggtctgagaatctgcatttctaacaaatccccaggtgatgcagatgctggtggtctgagtgccacactcagagaaacactgctataagacgagctgttcttttccccctgaatatctgaatttgtcctttttgaacttccccttagaccccaaaggcctatactcaaaactccaattgtatatccagccccatcttctttttggagtgggactcccatgtctttcaatgatcactagacatttccaactaaatgagattttgacggttcatactcaatgaccttgggaaagtgccctaaaatccagcaccatttcctcttccatattttgagaaatagtgtgcctttgtttctcaagttaccaagacttaaatatttttccaccgttttacttctcgatctgaactcttggtttactttattatcataaatatgaagagtgatttctagctagagtaatagctactgatgacagatacatttatcactgtggaaaaaacacctacgtcagctctttctgaattctgacgcacagatcaaagcttggtaagtcttggtagtctgaacaagcgccttctggagaagtttaaatgtaaaacaaagatttccaagtgccatcatgggttaataattttgaatcagaaattgtgagaatgatgcccaagaatcagcatttttaataaataagccttgggccaaatttgcaagccactgacttagatcatcatacaataagatattttaatgccacttggttaagtctggaataatttaatccttcttttatacttaagggactaaatcaaaaggcacattttccagcaatattagtacttccaactcttctttttccaacagtgacttgatgtgtgtgcagatcaatgttagttttatgttactatattggtgttattttctttattccttgctgatacccactttgggactctgcatgcaaagtgcctggataatgatgtaacacagagaagggtcctcaccttgggttttcctctaagactcctctgctagcattcctcaagcttgccagagcagtttatgcacataattgatctaatctttatttatcaatgaaactagccctgcggtttttcccagaagactctttggataacacagaggcacaacagaaagggcaccatgttaaaaatagaataaataatattttacagccaaaatgattgtcaccacctgttatatctttctcatctctgggtctctcctttagatgcattttttcccagagatttcttctaaggcagaaccagcagggaagaaaacaatcaaatgctttgcagcctggagtaaactttcacaggacaggagaagatgtgagattctcagcttctcctcccaataaaaacagcagcaatggaacagcatctcatatttagatttcaacagactggagtagggacaggggacagaaattttgcaaatgatgcagcttagtcaatgaatggcaacatttcagaaagcttaaattcatatgatgagggaggagatatgtctgggaacgaaagactagggaagagtctaggtgtttattcagcatcttcactgccccatctctgcacacagtttttgctccataccttctttgccaccaacactactgcccaagtagttgcttctaccacatttaccaccaccatcacctccaccatctccactgccacaaccccaccatcagcatcaccctctccaccaccatccgttccaccatgacaataacttccaattccaactccactctcatctggactttcaaacctgccacttccatcaccatcacctcaccattatcaccactcatcccaccaccctcacccctcatgtcaccattatcacccctcaccccaccaccatcaccccttactccaccaccactacccaccaaccccagctttccagcttcctcctgctcaccttcacgttctctctgctgagcagaggagcttcttaacactggagtttaaacaattgatgaaacatcatccgtgtgttctctctacaatagagcagaaaagatacaatttcttttttggactcacatgagtaattcatatttcccatttgcctagggccaggttttcaagaacaaaagctctcaataggagaggctgtccggagaccttgtatctctgctctgtatttccatccccagcaggaatggttcggggcactgcttggctttgccctgggttacattttcctctatgcgagtttccaacctgaagtcagatctgtttaaaataaaatgaaagcctctgtcagggagaaatatcaaaggatgactcttgcctagaggtagcacctacttttaatttttaagtattttatagagaaacatgtaaatttacacaatctgcagaattgttatttgcaggaacctatggtctcttcagagggaaattagaagttagaaagtcttaagaccttggtttgctgtattttaaaaggttcagtttttcttaaaatgacggtgtgaatcttttactcaagaattgtaactaggctggtcacggtgactcatgcctgtaagcccagcgctttgggaggccaaagtggaaggactgcttgagcccaggagttcacatggcaagacctcatctctacaaaaaatttttaaaaactagctgggcatggtggaatgtgcctgtcgttccagctactcaggatgctaaggtgggaggatcacttgagcctaggagtttgagactgcagtgagctgtgattgcatcactgcactccagcctgggcaacagggtgagacattgacacacacacacacacacacacacacacacacacaattataattaaaaaaaaacgagcagtatcaatgtctttgttctcacctctgtatctctacagcttcctcctactccgactttcacctccacagtcttttgtttgtttgtttgtttgtctgtctttgtttgcttgtttgtttttgtctgtcataagcattccaagatgaaaaactgagtgcctgtcacaaaactgaaaaagttcacagctctgagctcacaaatacatggttttggggttacataggccagatatccagtttataaaacaaagaaatataggcttggctaatgcccaaggatagaacaccacccatgattccgtattttttaagatgcgatggtttccctgggcaacagtgttgaattacgtacatgcatcacgtacagctgtatacagcgtgtggtccatataaaattaagcccacgaggactgattccatacaggaagctcctcatcttcgtttccctactacatttatcataataacaattcaaatggtctggatactaaacataacaattcctgaaaggatctttcattttagactgcttgaaacaatgattttttgataatgagtgagcactctgaattgaaaatgatatacaatttactgcaaataatcatacactaaaaacatatataggaaggaaggaattaacaaactggctataaacatatttgattctcaatcctaagaggaccacaaattatatatatgaactttgatgagttgggttatctgagttttattttcttgatttgtaaacaggaataaaataccaaaattatagacaatatttgcaaagtgcttggctcctgcacgcagtaaatagtgtctctacatactttggcttgtgctcttagtctttagttccttctcaacaatcctgtgcctaagaaataggtattgctggttggtatctgctgtactgtatgatctatgttctttgctctttgtttcaaaatcttactaccttattctagtttggagtctttgtgagaggcacaggtacatggtctgataacattttgagtctttaatccaagtgcttgtcaccattgtctttggcagaagcattatgtctatggaattaaattttttttttttttcactgtacagttttagtgtaggaagggagaggaaaccactttcagtgggatcaggtttacttggcttggagaagaaactgaatgtggattcctcatcaagaatatgcttgtaacactagtaaatatttccctagtaacaatagctgggaggaggaaatcatgtttaataacttaatgccaaatagcctgtggcttacagtggcacgcatgaacacacacacacacacacacacacacacacacacacacacacacaccacgagctggccattagctcaataactgttttaaaactctattatttatctcattttagtaaatcagataatcaatatttatcgattatgttcatcaccattttggtagacactatgacggataacaaaaggtaataggcatagtctccacttggaaagccattacagtatttaacaaagcaatacaaccatttgataccaattaaaagtaagttttggtttggaatggtagtaacttccagtgacgtgagctttcagaggatggcagctagttaatatagtattctctttgaaaaagacaactgttgatgtgtggagtgttagctatgttcaaattgagaacgtgagtgaagacttattattccccttctgttaacatctcatctcttcatctttctggatcttaggcttttttttttcctcgacattagtactgtacaattgtaatatgtaatttaagatattctaatagcctcattttttaaaaagtaacaataagtatctggaattaactataatgatatattttgtttaatttgatatatcccaaatattaccatgtcagcatattgcactggcacgtttgaggcacccgatagctgcatgtggttagtggctaccgtagtagatatggtggctctcgagggtcctcatgcagtggctgcaggacctgacctgagcttcatcacatctcttattttagaaaaaaaaagctgactccattgatggacgttcagcattgtgtcaagaacagggaatttctcctgtcaaagccttctttattgtttcttcttcaatttacccacagcggtcctggctaggatcctgtcatggttctcagtccttccctctttccttcagttgctgctgttgctgtccagctgaagattaaggtagaaccaaccgtggaggagctgccatgggcttttgttgtctacgggtttggggatgggacatccagaggggcctggcaggagtttaattaggattacagatgagggagacagaggaaagcaatggcaagagaagggggcaaacctgaacagaaggttccctccacccttctgctccctctcacttcaatgctggagtaataggatctgccaaatctcactttccccacctgggatggtgttggcaggtggtagggtcaaagagtaaagagaagcgagtctcatgtgggcattttcaattccatcacatacttttacttacatttgcatacaggtcagagtcaaaaatattctattttggtacctgatctgaaattatttgtaaataagacaattaaattcatttactccaaaaccatcacctcaacatctgaagaatgcccagcattgagccaagcactcatgtactaggaaaggtaggaagtggcccccgttctcaagggtccctgtcacacattagctaggaagtttggaggggtcatcaaactgaaactttccagaaacatctgtctgcattgagggtatattcaggacagaagggttacaatcatgtctgcttcatttttacttgtatgtagtatactttttaagttgtttttcaaaaaagttagtatctaagtggacaaaattaataggagcaattataggagcataacctaggtagagctgcctaatggttgaccttctaacagtggaatttcagtcatcactaaatacgtagaagacgcattcagggaatacactgtctttctactccctcaattatgtcactgctttatctgagagcaatggagttgtgtaggctggtgcactgaaaactgtcaattgggagtcaaatatctctcatttttcaagtagtagccagcctctggggtttgagcaggtcccagttcagccacctgttttttgtttatctttggccaatcacttaaattttcttagtttttttttttttttccacttctaaaatgagactaataacttcatctagttacctatcagttgcaaagaaatgagataaaaaagctatctatgaagacacatctcctcaaatgtgtttggcatcccaacagtaaatatagatcatgttactcttgaaataaaggccaaaaaatgtcttcactccccgtgtagaataaaatgcagtctgcttattacagtcttgaccatgcacaccaagggcactgtctccagctgacactgtgcgccagtcacgttggcctctaaacatgttcctccctttgttagcccttttttgtctttggaatgttcctccccaagggcaaaggtcaacaaactttcactctaaaaggccagatagtaaatagtttcatcttgggggccatgaggtttctgtcacaactactcaactctgccatcagagaagaaaagcagccataggcaatacataaacaaatgagcaggcctctgtttctctgttccaacaaaactttatttacacaaataggtgatgggctagacttggtccatgggccaccatcgtttgctgacccctccctagaccttttcataatggcttttctgatcattttaatctcagatcaattaggatctaaggccttccttgaccactcttttgaacatctccccaccccatctcttgattgtgttgctccgttttattgttttcttattatttataacctcaattatctaatgtattcattcgcttattgatttattgtacacatccattttctgtaccaccataattctagttcgaagggcaaggtctggaagaaagtagatggtaggtgctcaataaatgatttgtttcatgtgtgaataaataattacccaaagaataaaattccagaaggaaaattctgaattttagtgataggaaggcaagaacgcttgggggtagtcagaggcacaggaagatcagaaactcctgcaaactatgagccttccatataatctttcacaaatgaagcttctaaaaagctgacctgtatgaaacaaggtagttttttattgttgttgtctgcgcatgatatagactgttaatatctcactattttctggctataaaacaagcatactgataacagtaaaaatcaaaggtataaataaccggcccattagcaggctgtatgcttggaaatggttttgagggagacttttaaaggcagcttttaataagaccagccattcattccccatgcaatcaatcagcattctcaatcaaatgccaatggcatgcctttgtggttgctactgaggatactggcaaaatgaggcagcctctgccttctcagccatcaagagtaattatgtaatgccatatagacaaagattagacctatagtgatagggggatatcagccagtgtcctggccaaaaaaaaaaaaaggctcacatgaaaggatttaaccaaagagatgttaatgaagctatgccactcttatgtacagaggtgaggatgaggctaaagaaaccattcaggagatgtgagggaccctgggtccagcaacagttggaaaccactctaacctgtaggctagaagtcttagggagaaaatgatattaccagagtccagtgagaactgatgcctgaaggaggggccagccaataggagttctggccgtagagaaatgtggctcttactagaatctcatcaagacaagctttctatacttccaccctgcctgacataacaggaagtcagagggtaagagagctggtgtatgcaattcatgggagtcgggctttcagagcaccaagtaaggtggagaaatgcatgtgacattaagaactgagaacaaaagaaacataacaggcacagtagtaagagtaggtaagccaggtgataagagagattgcattttggaagtctgtatttactccattgattttatttactttgcaatatgtgaatgcagcagaaaataagggattaaaaaagcttttagaaatgtgtattttttaatacttaaggatgtaggctagaagagttctaggattattggcagagtttatctaactcaagccaattcatgtgaagtcaaccagagtcttgaaggattagaaaatacctttctagcctgttgcctggggaagaaacattccgaactaaggataatcttttgcctgggaagaagaaaccatagagtaaaattcatcaccaagataacattgaatcttcattactgcccaaaaagagagagagagagagaaatttaacatattcctggtaatgaaggtcagtcacttataagcaataatttccttttttttgaccattatcaataaaaatgaaatctctctttagcctgccaaaagaaaaaattataaaaacaggacctgttacaggctctattacagaactttgaaactggtatcttaggactatgctctctaacagagggtcatttcttcaagtaactatatgttgaactcttattatcaaatgatgaattccagtctcccaaattactacttgcttttattaattgagttagtgatgcattacctcactttgttgcatagtttttggtccaccaagtggctgcacgaaagaaggaaatgaagtgctggggatttccttaggcgattacaagaagacaacttttaataccaaagtatttatcatttatgattttcctagttgtcttgcagtgatctaagcaacttgttttgtgatttattatagatcttatttaggtctgtttttttaaagagaagtttcaaggaaaaaggaacctctataaaataatttcagtcggtgtcgctgttcagtagatgacatctgctggaatgaatatggtctagatgctgctccatctcctttacagattgtatgcttgtctagaggatgtatgccacattttatccatgaaccttttctaccacacgcaccattctttatccccatgccccatcattacgccaatgccattccctaataaatgaatgtgaggggttttaattattttgtgccaaatttcttcaagcaactatatgttgaactcttattatcaaatgatgagtttgagtctccaaaattactacttgttttcattaattgacttagtgatacgttacctaactctgttgcatagttttggtccactaagtggctgcaggaaggaaggaaatgaagtgctgggcatttcgttaggcgattacaagaacacaacttttaataccaaagtatttatcatttatgattttcctagttctcttgcagtgagctaagcaacttgttttgtgatttatttattggaacttactaagcttttttttttttttagatagacgtttcaaggaaaaaggaagtttcataaaataatttcaatagatgtctcgttaaaattcaagttgatttcagtgctattctgacctagctaccaactagctttgagaccccaaacaagccacttaccctctgtgatcctcagttttctcatctctaaaatgagggggatgggctaagttgtccctaaagccctctaaagtgctacatgctgtaattatgagtctatgttatccccggaaatatcatgaaaaataaaaataaaattgattgagttgaaaatggtccaacagttacaaagaaatatttgacattgtaatcatgcatcagttagtttttggctctttaattttgaaagcagatgtttgattgcttgtttaaagcctgcgtaaaaaaccccaggcaaaccttgcaaaagctcaaaatattcttaagcagggatatcaattgcataatttcctagaccttgcagattggttcaaattaacccacagcatatttgaaagcctttttcttttgtgagcatctaaccaattccccattgctctcctcctgggtatctattcgttatcaaaaccggaagcacagtgtggcatccaaattggagttcagtgtcagcagaggttacatttgtacatttcccagaaaaggaacaattattgtcataggagaggattaatgtacggccattttgggtctttattataatcttttctttaagaatgaggaattggaatgttaatgtattcaataatctatgaattatacaggtatgctatagtgctttgaccttttcaacatttggtaattttgattgagtggctgttctgagcctgttctttttaacagctctattatcctgtggaaaagaggaaggctagccaaatttcaaaaacacatttatcccgaagcaagaatagagggaattagttacaatgtgccagagagagtgcaagatgacttacagaccttctctgatgtaacctcaacaacatctcatgagataatattattatcaccattttacagatgaagaaattgggacccaatgcatgcctcatgggtaagaggcagaggcaataataatcccagtactatatgatatcaacatctatacacttgcacaaaggtaagagggagaggcaattattacccctgtactatgtgataccaaattctatacacttcctactcaacaggtctttgatttttgaaagtagtaagtgtatctattaagcagtaaatacctgtaaacatcctgcattagactgttctcacactgctaatgaagacatacctgagacagggtaatttataaaggaaagaagtttaattgactcacagtgcagcatggctggggaggcctcaggaaattaaaaatcctgttggaaggcaccacttcacagggcatcaggagatggaacgagtgctgaggggaaggggaagccctctatataaaaccatcagaccttgtgagaactcactcactatcacaagaacagcatgggggaactgcccccgtaatctaatcacctcccatgagttcccttcgacaaaacatggggattatgggaactacaactggcgatgagatttgggtgggtgcacagccaaaccatatcattcttcccctggaccctcccaaatctcatgtcctcacatttcaaaatgatatgtctccgatgagtggaggaacacccggttcttcatcttcagtcaaattagataaaacaacatggatacacatggaatggttttgagaagtggagagtttaatatgcaagaaggaagtggggagaaagaaagaagcagatccctggtacacagacagagggagggggcctccaaagccaaaagagggaacttcaagtgccaaggataccagccagttttatgagtaggctggaggaggtggtgtctgatttgcatagggctcacgggattggtttcaccaggtatgtcgttcacatagcccgtgaaaaagctggccctcccaccctagcctgttgatatgcaaatgcagggcaccatgatgttctacacactggggatatgtgggggtggctatgctgctaggcatatgtgagggcaaggataagaggacaatggtggtgagaattgccatgtttgatggactcagtttctaatggctggcatttgcacatcaaagattgcctgccaggctctaaaagtgggggttttccttctagacaagaagcatttttgcagctgctttaaaagaaacgaaaactttttctatctgcctaaaataatttcttaataactcctaccacaaaaacacaaccccactttcccaacagtcccacaaagtcttaagtcattccagcattaactcaaaagttcgagtccaaagtctcatctgaggcaaagcaagtcccttccacctatgagtctaaaacaaaaaggaagttagttacttcctagatacaatggggtacaggcattggttaaatacatcctttccaaatgggagaaattggccaaaacaaaggggctacaagctccatgcaagtccaaaatccaatagggtagtaattaaatcttaaagttccaaagatgatgtcttttgactccatgtctcacttcttctgagtcatgctggtgtaagaagttggctcccacagccttaggcagctccacccctgtggttttgcagagtacagctcccctcttggctgctttcatgggctggagttgagtgtctgtgaattttccaggtacatggtgcaagctgttagtgaatctacaattctggggtcaggaggatggtggccctcttctcacagctctactaggtccaccaggcagtgcccagtggggactctgtgtgagggctcccaccacccattttccttccacactgccctagcagaggttctccatgacggctttgcccctgcagcagactttgcccctgaacatccagatgtttttttacatcctctgaaatctaggcggaggttcccaaacctcagttcatgactttggtgcacccacaggctcaacagcacttggaaggtgccaaaccttgaggcttgcactctgaagccatgacccaatctgtaccttggccccttttagccacaaatggagcgaccgagacacaggacaccaagtccctaggctgcacacagcagggggcccagggcctggcccatgagaccattttttcctcttagcctctcagcctgtaatgggaggggctgccacaaaggtctctgacatgccctgaagacattttccccgttgtcttggtgattagcatgtggctccttgtttcttatgcaaattactgtagcagggttgaatttctccccagaaaattggttttgcttttgtattgcattgccaggctgcaaattttccaaacttttttttttttaatgctttaagttctagggtacatttgcacaatgtgcaagttcgttacatatgtatacatgcgccatgttatgctctgcttcctcttgaatactttgctgcttagaaatttcttctgccagatactctaaatcatctctctcaagttcaaacttccacaaatctctaggacacgggcaaaatgccaccagtctctttgcagagcaagaatgacatttactctagttctcaacaagttcctcatctccatctgagaccacctcagcctggactttactgttcatatctctgtcagcattttggccaaagccactcaacaagactctaggaagtttcaaattttctcacattttcctatcttcttctgagtcctccaaactgttccaccctctgcctgttatccagttccaaagctgtttccatgttttcaggtatctttacagcagcaccctactctaccggtaccaatttactgtattacttctcacattgctaataaagacatacccaagactgggtaatttataaaggaaagatgtttaactgactcacagttcagcatggctggggaggcctcaggaaagttacaatcctgggggaagggaactctttgcagggaggcagaaaagagaatgagtgccaaacaaaacgggaagccctttgtaaaaccatcagatctcatgaaaactctgtcatgagaacagcatgggagaaccacccccataatctaatcaccccccacgaagtccctcaagcaaaacatgggaattatgggaaatgtaattcaagatgagatctgggtggaggcacagccaaaacatatcccatcttaaaattttatcttattccacattgagctttcaagcatttattagtacttatgatgccctgtaaccttctgtagctggtagaatgatgaaaaagaccaaaattccccaccccaaaggagattagagctgcggagtatattgactcagggttatgggaacacaaaagagatggtgaagcacccagagatgagtgattctggtgaactggtatgtaacacttctgctcagagcataaggaacagtggaaggaaacagtgttaccagggccatatggaaatttgaacagtggatgtaggactacccagtaggagctacttccaaaaatggtatgctatggctagaaaggagggaaataaaataacccattctctctgttgttctctgttctcttaccagtgtcccccattagctgaatccagccagatgtcagccatcacaaaaactcagtctctaagggtttcactcagagcagggcaaggatggatggaaagggactgggaggaaggcatgtagaatcatcaacagaagggctttccaaaactaaagaataatgtggcttgaagataaagtcacatctccatttctttcaaaacagagtaccagcaatttttaattgattttttcctcagcttctacttaccaaaattctctggagttttaaccagagtagtcttatgtgtggaatgaagaggggaataaatggtaccaaggataataggatgagctcaaatcagtctgtgcttatgaccttagtgttaatactgtgaaatgaaagaaatatcgtcatttctcattttggtgtagagatgctaattctacactcctcttcaaattactgagataatagtatgtgactgatgatgaattcctagataacactgggctgtgtgcctttgaaatattgagagaaaaactcatgatattgatagtccattagactagaagatgagatttcaaaatgacaatggtaatgagggttcgtttttggcaaccaccttgattcagttctataaaaggcaaagaaataaatacatgactcccctgagtgacatttagacaaaaggtggttctgtgccattgtcggatagctttcaaaatcaatggattcagcaagttttgttcatttcagatatttggtacatcagagttccatgttagtttttttttttattttaagatttaattattagaaataaatgtacttagaatattggagacaggaaagaatattaggaaattttgttattgctaggaagaatctaaaaatagcgttaattgattaaaaagtgaattattgtgttagaaactttgtcttttaacaattacaaaccaaaattctaaaggaatatctaaaaagcttatgtaataaagtttcagaagactaggaaaaatagccttataagctctagatcctctctaacagagatactgttgtaggtaaaggagacacatgctccaataataagatgaaaccctggtaaccctggagtggcatcctctagcaaacaggagagtaggctttggtttgattcactcaacaagtgctcattgagaatcttctccgtgcagttaactcaatgctgtggaaggtataaagctatcataatatcagctgtagacaaatgaaaaggaatgcagttatcaagaacttcagagaagtgcactttttgctgagagctttggtaacctcatctgtcagtgtaaaatcaatcagggatcttccctgtaggctccgagagtgactatatatttctcccttcaaaatgttttatccaagataattagtttaacatttaatatctgggacttcctcacaggaggaaaatgtcatgaaagaggaaagcattggaatctagaaagtgataatataaaagttgaaagaggcatatttagtctgctttgcctttgagaggaattgtatgcctgttgagttctatttcttttaccttcatgtgctggctggctgagtcactgggcaactgggacccagggtgtccacctgaccaggtataatttcaatcatgcatacagttgtcccaggattttcttgggttatagaatattttctaaacataaagaagctatctctcttgcttctctcccgaagaattactttcttatcagcttaggcataaaccgaaaggatgctcaattatatgtgcataaaataatgattcattgaagcattctatgaattttatgttcccccccaactccaaacacagacccagaatttgagataaagagacatatgcaatttaatattatttaatgcgtgacgagtctgatggaatagatattcaactcagtgaccttgaagtatagagtggctagtatgaacagtttgcatgctacactgtatagcctaaataacagagggcataataaagtaaaaactgtaaggttgtgatcagcttctactggtgagggagagagatgattaatggtgtaacgaagaaattatcatggtgtttctattttctacaaagctgttttcagcttcaaattagaagttactctttttgccaaaaagagtggggtataaaccacattccaattgctgcaataattctgacaaactcaaaggcagatagcaaagcatctggaaatgggcagatcaaaatgttgtcttgaaaaatagaaaaacaacctttccaatggaaaaatacctggtttgtagcattttgcagcatatgtaatgtatagagtaaaatgtatgccctgggtagctaagaagagaataaaaatgaattaggagaacctaaataataaaataatgttgttttcataattatatataatgggaacaatttatttactgacttcactgaaacatgatgtttcagagcttttaatcggcttgtgaaatgttagaattatttctgtctcaaaatatgtaaaagtatggtggaggagaaatagtaataccttttcctcacccagggacctatggaaaaggtcatgcctgacacctctaatccaaaagatagactggcaaattaaaagcataaaaagtttatttatcaaaatttcatgtggcatgggagcttttggaattaaagttgcaaagggccagagaaaattttttattttttttgagatggagtctcctctgtcacccaggctagcgtgcaatgtcatgacctcagctccctgcaacctccgcctcccaggttcaagtgattcttctgcctcagcctcccagctagctgggattacaggagcataaccccatgcctggctaatttttgtatttttagtagagatggggttcaccatattggccaggctggtcccatcctcttggccttgtgatctgcctgcctcggcctcccaaagtgctgggattacaggcgtgagccaccgtgctgggccaagaagactatttttattgctaagtctgatgaaagaaatggatagttgtagagaaacatgattggataacaggagtatgatctaatggtaatgaactggagacaacttcgcaaggccagattcttctctgtgtttctgtaagccattcattgcccctgggtatcaggaagcacatctgtcacatgaggatctgggaggtggtgaacgtcagagagtgatttttctaggttttatggcttgtttgggggtcaggagggggcgatttctcattcctgtgacctgcttgggggagaaaaggatgttaagttctcttatgggagtttgcagatactgttttgactctgaatatagagactttataactaagccatggtcctcaaatcaaaagtaatccgtatgtggtaatctggagaggtgtgtaataattattcttgtagattcagaccatcctaaccataatcaatgctgggcaggtaataggagatgttttatggcaaatgattcagtcaatgttccaattattgaagctctatgtaggagaaagacaactgtagatactggtttgtctatagatccattgaaaaaaactggggtactgacttgttgaccatgactcatggggacaagaccacaactgcagcttagtatctaattatggccataagccaccaactacttaataattgtctatatctagtaaatatggcatatatgtttacggtatatacctggactcctagtattctctttgagccacttttttgatttattaattgttacttgctttgtgtgtgtgtgtgtttgtgtgtgcatgcatgtgtgtgtgcatgtacaagtgtttaatccattagtctcttagcatataaaaatgtttttcttgtaaaaagatgcctacctatttagcctgtgcagtggaggaagctgggggaggtagatcaagtacaactgagaattttgtgaggattcaaaggctcaacatttttacttccttgtgagcctttctgccttgcaaaggtcaacacactcacgtctcttccccctccagcaatagtgttttcagatatgagcaaaatattttacctcaagtttcaccattttctttttttacaataacagaaagcagatttttattcagagtacacttacagtggctttgtttttcttgctttgtagaaaaaaacagcatttatttatttattcattttgttgttgtcagagtcaaaatgtaaatttcttcttccatttactttgacattgcactgtatatgtactatttttgaaaagagtggcatattctgtgaacaggtctttcagagacaaaggaaataaaacatggagaacaatgcaagtttcatcctctgataatgggtagatggtctacggccataccaccctgaacactccccgtctcgtctgataatgggtagatgttctcaaaaggcaaagtatatgaaaaactttaatgtaagaagaacataacataacttttatatacaattatataattcaacataacgttaatcatcattttattagcacttttttatcattgttagatatagaaacatagatgcattaatatatacataaacatgacatatttctacatgcacacaaatatggagttaacgtttatttagaatctactaatatgcttgtggtagaactacaaagatgaattatatgaaaatcttatagtttagatggaggtaacttaaactacacataaaattcctggaatagcgccttccatgaacaaggcactcaaggaaaatttgtgcaataaatgaatacataaaacaacacaagtacaaagcagcatgtgctgtttggtaagctaaaatgcaccagaaggttcaagagttaaaagacatagaagaagcctgaaggcaatgaaactattgatgtatttgcagagaagttagtcattgaagtgtccaagcaggcaggtgcacatgcactgggatgcagctatgcaggttggaggaggcaggctccgcagatagggagagaagaaagcggtgtatctgattttcttttcttttctgtttttggagagagatattgaaaatgaataaacagtccagggcatagaaaagtttgtgcaataggggaaaataaagtaaattcaagggaaaataatagtctaaggtctcctataaaaatagtctagttactaggccaggtgcggtggctcaggcctgtaatcccagcattttgggagaccgaggagagtggatcacgaggtcaggagttcaagaccaccctggccaagatggtgaaaccccatctctactaaaaaactacaaaaattagccaggcactgtagcaggcaactgtaatctcagctactcgggaggctgaagaaggagaactgcttgaaccgggggcagcagaggtagcagtgagccaagatcgagccactgcactccagcctgggcgacagagtgagactccatctcaaaaataaataaataaataaatataaatagactagttactgatgagtatagctatttacaaagggacacataagacgtttttgtcttttttttttttaattttttttttttgagacagagtgtcgctcttgtcacccaggctggagtgcaatggcaagacctcggctcactgcaacctccgcctcccaggttcaagcaattctcccgcctaagcctcacaggcgcctgccactacactcagctaattttttttttttttgtatttttggtagagatgggttttcgccatgttggccaggctggtctcgaatgcctgacctcaggtggtcctcccgtctcagcctcccaaagtgctcggattacaggcgtgagccaccgtgcctggccggacgtttttttttaagagaaggacagaagtcaagttatgtatcttcttaaatagggaaatacattttacttcctctaccattattactattttttcaaggttcctaaaatagttgtcattttacataacgttttcaaacatctgtgacagatcttgaaagcgtcactatgcgtttccttaaaagaacacccatttcagaacccgtgtcgtctctttttcttccttttccacttccacgtccatgcgatcaagttgggttcaagctgccgctgcggcctgtcttgaacccacccattttcctctaagctctgctgccctgggcctactgactcctgtcctctcactgtccttactgctgtcctctcctgggctgatggccgaaaacgcctccctcacgggctcctcaccctaagtaggtaggtctctcccaccttccatctaattttcacagtcccatcagaattttctttataaaggctggtatggctacctaagttcccgttattgcccagaagataatcccaaactgcctaatatggtattgatagctctcaaaatggggccatcgagtaccccccttacactatctcccattcgtttatcccatctacaccgagattcagtcaacctgctttgcttttcccaaatagtcaaagatgacgcatgtttcccatcctctgttctgtgctgttcattcaagttttttccttgcctggagtatcctcctttctttcttttagtcagaaaagttctattcacatttcaagatccataaaatgtcacgttctgtttactcacttattgtaaaaacgtgtactctcttaacttcgcctttctatttatacacaacttacatgtacgtaaatgtgccttctcccctccccgttacacccagcacacatattgcctagcacacagtaggttcataagaactgttgaatgaaattttcaaatcgaagcagatataacaacctcttattttttttaaaaccacttttgtcaatttattcagcctaatgaatatttttctatatatctgccatatgtatagaaaagtttatacatagtttctttatcaggcctaacagaataacttttactgtattaaatagtaacttactcaacttgtcaaactggagaggcaattgatttgagtattaggtctttacattgcatcaaccaagttgattagtcatttttaaatttatcattagttaacattaaaaaaaaagttaaaaacaagcattgctcaagcccccttgtttcgtgtttggcacactgcatagcttttaataaaaagttatttttcaacctgcagtggaatatttaaacatccatgcaaagattttttttttttttttttttttttttttttttttttgctaaattttcaaagaacatcagaaatgttgtattaaaaaacagatgatggggcagtaaagacttttttatttggtagtagaaacatatggggaaataaaatgtattaatgttgtaattataacattccaatgtttctgctttctcaagtttttatactaaaaatctttcaatagaacataactttaaagatagttttctttatactaggttcatgcatttgtgtcccatatttcaccataagggatatttgtaatatatttctggaatgggaaatgggtcaactatctagctgtccagtatttcacatttatgaacagaacccccaaactgaaaattagccttgggtgtttcataacttaggaccaactcagaaatgtaggctttggaaagcaaataactgtgatccaattttcgggaagcaggtttgtcttttatggcaaagaagagtgatcccagttttaattacaggcattgagtgtccctagccaaaactcagtctgaggtgtttcagcatggaagatcatttgggaaagctgggtttgcagaaagcacgagcaataaagacataacatataaacagatattctgcacgtagtttgcaaaatcttaacctcatcaaaagaagagatcaaaattctatttaatgcaattggagattaagttgcagagtacaatttaactgaaatacagtaccacattcatacttcaaatggtttatcaaaagaaagactaaaaaagactggttatgtgtctatataaggtttgctcttctctttctctctctttaattaaaaaaaatatatatatatataatatatatgtatatatataaccaaggcaaaaagtaagaggttgatgctctctgtccaaacctctcttctctctctttttttaaatatgtgcttaatatattcctatcttcccaatattttaattaagaacaatgtttgcacacatttaaatgagtgacatctttgcttaaatttgtttttgactaattattttccacgtgttttcaccttccaacactaccttagtcctaagttatgaaatactcaatgctcttcataaaatatcttgaaataactttttatttcaaaattaaaattaaatcacataaaagtatgttcttaaatagactatagttttcttagatcttgttgagattaaaaacaagtgtgatctggccctggccgggggtggtggctcacgcctgtaatcccagcacttttggaggccgaggcaggtggatcaggaggtcaggagatcgagaccatcctggctaacacggtgaaacaccgcctctactaaaaactacaaaaaaattagccgggcgtgttggtgggttcctgtagtcccagctactcaggaggctgaggcaggagaaatgcttgaatccaagagttcgaggttgcagtgagccgagatcgcaccactccactccagcctggcgacagagcgagactccgtctcaaaataaataaataaataaatgaataaataaacaaattacctttaacttagtatgaccattttggattgctgtaaaatattccataaaatagtaagagccttcaaatgtaacttagagtaaatgggcaaatattatttttcctatttacagagatatctaatagcccaaacaaatatttgaaatcaaagttatatttgaatgcatttctgaatagatgaagggataaacagatagtaatataaaggagttctgcaatgctatgtctatagacctcatgccaaaaatggggacatgagtcaagtctacctaacatgtttctattttctaaaaaaaaaaatttaagtactttaaatgcttatgctttgaataagaataattgccatttcaaaaaatgtaactaaatatgtatgcatgcatctgtgtgtatacagagacaagcagtgatttataattttgagaaatacgatattctgattctgattaaaatagctaaaattcacaaattcaaagttgtgaaactaaaaaagaaatttttttagacttgtggattaaaatcttggcattctactcatttaactgtatttatctatggcattttcatttggcataattttcatatattttgtaataatatcacattggctgcataatatgaagtcccttgaaagaaactagatttcaattctgtggaagaaataatttatgatgtaagagttgtgattatacagccaatatgagttaattctttaaaaaaaaaaactaaattgatcaagcaaaaaaatgtactcacttgtttgagaatgtcaatcattttcaattaaattatctagatgtttcccaggtttcagctgatatatttttcttaggaaataatattttatctcattaaattatttctcttgaatacaaaaaatctttatttagccatcagaccaaaaataaataaataaatagggacagctcagaaggagtgagcatagttctttctcttccaaacatacaggtggaacgtatagtgctaacagggaatattctgtgacatcataattttgggcactgaattttgattgcagtgtgttcttcagagtcaggcacctccaagtctgcctcttaatactgccagctgatgcctctaagcctcagttttcacatcagccaatgtgaccactattacatacgtcattgtgctactgtcaggatgacataaagatgctgcatagaacacgtttagcccaaagcctggcacgtgataagaatacaataaactatacctatagtcagggcaacagaaagacaagaattgatatggtcaaaatcataaaccctctttttgtcctacggaaggcacaggcaagaatttggatgacacatggtggtgcttctgcccttactagtgacctaaaaccaatctgccaaagtataatgattgagttttgcagaactgttgctaagagatatataggtgtatatgtacatgtatacgtatataaacatatacacacacctatgtatatataagccatatctacacacctatgtatatataagccatatctacgcacctatgtatatataagccatatctacgcacctatgtatatataagccatatctacgcacctatgtatatataagccatatctacacacctatgtatatataagccatatctacacacctatgtatatatataggccatatctacacacctatgtatatataagacatatctacacacctatgtatatataagccatgtctacacacctatgtatatataagccatgtctacacacctatgtatataaaagacatgtctacacacctatgtatataaaagacatatctacacacctatgtatatataagccatatctacacacctatgtatatataagccatatctacacacctatgtacatatcagccatatctacacacctatgtatatataagccatatctacgcacctatgtatatataagacatatctacgcacctatgtatatataagccatatctacgcacctatgtatatataagccatatctacgcacctatgtatatataagccatatctaagcacctatgtatatataagccatatctacacacctatgtatatatataggccatatctacacacctatgtatatataagacatatctacacacctatgtatatataagccatgtctacgcacctatgtatatataagccatgtctacgcacctatgtatatataagccatgtctacacacctatgtatatataagccatgtctacacacctatgtatatataagccatgtctacacacctatgtatataaaagacatatctacacaactatgtatatataagccatatctacacacctatgtatatataagccatatctacacacctatgtatatataagccatatctacacacctatgtatataaaagacatatctacacacctatgtatataaaagacatatctacacacctatgtacatatcagccatatctacacacctatgtatatataagccatatctacacacctatgtatatataagccatatctacacacctatgtatatataagacatatctacacacctatgtatatataagccatatctacacacctatgtatatataggacatatctacatacctatgtatatataggacatatctacacacctatgtgtatataggacatatctacacacctatgtatatatataggccatatctacacacctatgtatatataagacatatctacacacctatgtatatataagccatatctacacacctatgtatatataagacatatctacacacctatttatatataagccatatttacacacctatgtatatataagacatatctacacacctatgtatatataagacatatacccacagcgattttctatcacgttcgtttttaatcaaataatattagtcaaaaataaatacgtgtttgttttattattcctttgcttagttcctgccagtactagctggcttttctagtggaaggctgatcactttttccataaatccatttaatccaatcagtcttggcaggattgagacatgttctcagtggaggtcaagatcttgtttcctggtcactaagagcatgggataatagtaaactccagaaccatttgtaaaatactgtcagtcagacaaatccaaatacctgtcatgtgcccagtaagttattgaactttaagagaataaagtatgacccttattattgtgtttctaatcttctcagaaagggaaaaaagactatatataattagtgctcagctgtacaattcagcatataagtagaaattatttcactatgaaatcagataattgagacaaaattttagattgagtgagtaataatagccttatcttcttttgccctttatcctcttcccacatttaaactaggaagagaaatgaaacaagtcacctgtggatgttattggagagtattggatatgattctttgctcttacctggtgctctttcaccccacccctaactttctccttaactctctggcaattccatgcaaggccacctaaaatacccctttctcaataaagattttcctgaattcccacctaaaaataatttcttccttctctgcctttcatagcactttatgtgtgctgctccatttgtgacccatgtgtattctgttttagttatttatcaggggaaattcagccagatatcgggcaaaattcaccctcgatatttcatgtaggttcttttctgttttccctaagcattggccagtttgggaaataaagggacagagtacaaaagagagaaattttaaagctgggcttccgggggagaaatcacatttcgggaggttctgtgatgccccacaagccgcaaaaccagcaagtttttattagtgattttcaaaggggagggagtgtacgaatagcgtgtgggtcacaagagatcacgtggttcacaaggtaatagaatatcactaggaaaatggaggcagggcgagatcacaggaccacaggactggggcgaaatttaaattgctaatgaagtttcgggcacccattgtcattgataacttcttatcaggggacagggtttgagagcagacaaccggtctgaccaaaaatgtattaggcgggaatttcctcgtcctaataaacctgtgagcactatgggagactggggcttatttcatccctacagctccataaaagatggccgcacccaagggggccaatttagagacccacctcagtgatgcattctctttctcaaggatgttccttgctgagaaaaataattcagtgatatttctcccatttgcttttgaaagaagagaaatatggctctgttccacccggtcactggtggtcagagtttaaggttatctctcttgttccctgaacattgctgttatcctgttcttttttcaaggtgcccagatttcatattgttcaaacacacatgctctaaaatttgtggagttaatgcaatcatcacagggtcatgaggtgacatacatcctcctcagtttacaagatgacaggattaagagattaaagtaaagacaggcataggaaatcacaagggtattgattggggaagtgataagtgtccatgaaatcttcacaatctatgttcagagattgcagtaaagacaggcataagaaattataaaagtattaatttggggaactaataaatgtacatgaaatcttcacaatccacgttcttctgccatgtcttcagccggtccctccgttccgggtccctgacttcccgcaacagctatttcataatattagggattgtatggctattcagacgtccttcttgagggcaggctctttatcttttcctcacaacagttagcagtgtcatggagatagcaagtattttatagaaaatattgagtgagtccatgaatacgttttaattatttgggtacttaaatgtagaaggttagttgctttaactgtgcttatacaatggaaaccctgttctctgtcaaaaaaaaaaatgtgaagatcttgaaaaatgtggagaaactggggagcagctaagtggctctgaactagtcagattaggctcatctatgctgtagtaacaaacaagcccctaaacctcaatggcaattgatatttatttctcatgtgatctgcctcacaaatcattgcaggaaataatgttaccaatgttttggctcttcataaaacattcattattttctctgtcttttatatagttttctcacccacctctgctcagcccctgtgacaatgtccatctattgcaggtggtggatacaacagcagcccacttatggtatcagtttatgtttcagtcagagtagaataagctatgctgtggaagaaaataaatgctaaaatttcactggcataacaaattaatggttaatttctcaatcatgcaagtccaatgaaagtgtactaggtggcttttctccatcttgtggctgtgccatctgaagaatgtgaccttaagatcaccacacatggaaggaaagacctgaaggaccatgtgaataaagggccagattggtctgtggccatatcacctccactaaatccattgccctcaatccagtcacatgcatcctaacctcaaggaaaactggagaagcacatggatggatacctggtgagaactaatagcatatgccacagattctatagtggcattagaagttcacctaattcttaagtcttgtttttatttattttattatttatttattttttgagatagagtcttcctctgtcacccaggctggagtgcagtgtcacttggctcactgcaactgccacctcccggatttgagcgaccctcccacctcagccttggagtacttaggattacagctgtgagctaccacgcctagctaatttttttggatttttagtagagatgggatttcaccatgttggtaaagttggtcttgaacttctgacctcggtctcccaaagtactgggattacaggtatgagccactgtgccccgccctaatttttaaatttcaaattttaaatttttaaattttaaagtctgatttttaaaataccgaaaggtataccctccaatttctccctaggaatatgccctgtgttagtccagaagatgctgaaggcatatttgaggggttaccatgggggcattctttcatctgatcactgcagatttctccttaactctgtcatgtctcatcagtgtagactgacccacacttttccacaccatttacctctctggattggattgactattctttatctcatttttaacctctcctcatctgtcttcatggagatgtagttttgtgttttaacatctctaagaatatgttttgttaatgtaaattatattttacatatcctctgtactctattttatgtatcatatcctctgttttttaatattatgatgcatactataatgcctcttacatgatctaattatagaattttgacaagtacactattgaaaatcagcctcataattaacagatattactttattttgctgcaattaattgttgcctgctttatcttagcaattatttcttggatggcagaattggataatctgtgttgccacatgggaatatctatgtaaatggcaattaaatacatcctattaaagtatggtgtgaaagagatagatttaagttgggaaataacttccctgtgaccttagagagtttctggattgatcatcagataagtctacaacagatgccaaagaaggtagtatcagtttaagagatttcattcagctaaacacatataataaggaagactatttccaggagctactatgtacattaaattctattagtgatcatcaacaaaatttattaacataaaaataataaagccatctgaagaataattactgcctattgggagaaaaaaatagaaccatgaagaaaataaactctgccaacttagtgattttcgttaagtaaccaaacatttctactttgtgtcttccaaggaaattctttcacttatcaagtgttatacatattctttgttctaaaactgctctattcagctgtcattctatgattttgttttcaaggttgccccttctcttcttactcattttaattcttttctctttgtacttagattaaaataaagtcaattttaggactgtgaggtaagaaaggaagaatttgaaagatgcaacgtccttgtttatagtagatatttcaaagaaaaaatgtaaaattctcgttaatctaagaagactcagagaatatacaagatttaaagaactatctttaataaactattgggtagcattgcacactcagggcttacaactgaaaaaagaatctggcaattttatgcatgaaaaaagcaagagtaaactaatggtctatatagcatttcaggaggtgggacggttctttccaggttcatgtaaagctgaattggggtaatatctctcccctccacaaacatccccactgggccttcacaaagcctgtgaaacagcaaacagttgttttcctaagtaaatcagtatgcagtatcaattttaatgaaatcctttaaaaatatttataagacatactttgtgagctggctcttgaaaagtgattagggattgaatatgtggagagaagatttttcattttgttttatgtttttgaaaactaatgagaacaatgtttgaaaggaagaaggagtaaggtcagcagagtgggaagataaggcaacccaaaactcatcaaagagctaagcaaatggagggcgaggggcattccgtttggcctgttctcttggataatttatgaagttcaagtcacagaactgggaataaactcccaaattttcaggttctgtgacccattcgcttttcactctgctcctctcctgcgaactaaaaagacctcgaattttaaaatataatcaaaaccccccaaaacttaagaaagtgtattctcctttcagccatttaaaataggaaaacaatgaaaagaaagcctcccttaaaatctgaacattcaaagctttcagttaaatttatagatttattcaagaagagttgtcattctattaagttagaagttgactgttgtactgcctcctccaactgtatttgattccagaagtcacagagtatttacactttgtggttcttctttctgtcgctaatccacataagagagatacgtattgtcactctattaaacaacttatttgtggtttgactgtgattttccctgaaccttatatgtgtttcctttcattatggttagaatcttgggcagatggattttttcttatccatccctgcctctgttccacaggcacacaatatcatccttacatatgtaaatcacattaaactggcaagcttccctaccagactggaccctgcagggagcagggtatgtgccatgcttatttctgtgtccctcactaaacctaacacaggatcacacagtagagattcaacagaaatttttgaatatgtattatgttttttaaaccacattgaatttaagtaattgcttattatgaaaacaataactattaattacagatagttgcacaccaaaaagggaaaaagcaatcttttcaaaactgtcgtatgactaaattaaagtcctaatctattttccccttcatgttggtttgtagatgtattctcagatcaaatactattgagattcaggaaagcttgtgtttggcaaggtgaatcattgactgcatagggctggcagccaaaaataaaatagttgattgcaaataaaatgataggctaagaaatctcagcagtgcacttttggggtaagactatggtttgaggagaaatccattgggaaaagtcaacctgggcatgatccaagcaatgaatgcctttagtagactagattcagcaaatgaaactgagtgatttcaaatggaggttcaatgtgaaagtcagagaatggggagagattgagtttatatttttcatttccagccaagttatggattagagtgtttcccaggaagagaagtactagctggggttgagaatcaacttctaggactgaaagaaacttgaaatactaggcaagttttatggtagacagatctaccataaagttaagaatcaaagtggaaactcaattctgtgaacttacccagcacaggatggggacatggaaagccatgattgggagctatacagaaatctgggaattgctgtgatccctcagattgaggtttccaagacaaagaagaattggttaggtggagagaagtggagacacccggcactcatgctgggtcatgctaagttaaaaggaccatggcttcattccaagtctgactcaatggtaaagaaacagttgtaccacttccttagtcaggctttgcacatgaactaggctagagctagagtaaccatcttatctgttttacataccagttctcttttgaatatagaagaaatcaccttaataattatgtctggaccatagtcaaaagcttggattttctaggcagactgagacatattgtcacctagagcatagtctattgaaggtaatgggggctgagtttcagggatctttctgaaaggaccggaggtgatagaagtaggagagattgggttagttttgacaacaattatgtcttatctacatgtgaaggctatttggcattccttaccagaaggcactaatggctaggttaggtgggaaaaagataaagacaccctgccagtggttttctggaggactgtagtggaaccacaggaggaatatgctggaatgaaattcttcacgggcatatccttttggatttcttagtcaatcatgaattagatgatcaggagatgagtgactaagtctataggacgagaagaaagagacccatcaagatgcacagcaactccccatgattagaatcatggaaaactaatgcatatagatcagggtacagaagataagatgacttctcttccccaggaaaatccctaaagtgaccagaataatgtgttttctccagtcttaagaatatatatttagggaaatgacatttgtagattttccaccattgccagtctacatagttgagaagaagcaccaatgttatcatgtattttattcactgaaagaatcacagagattcaatagcttgtgtttccaagcattatgggagactgcttaacaagtccagaaatgctgaataaaatatcacaaacattcttcagatgagattctaaactgctagaaagtaagggacctcaccggagacaaaaaagagagagagagttgaaaacctgaggtacacagcacattcaacatcagactaggctttgagcaagggacaggagagatttgggaatgaggcactgcccataacatcagagcccataaaaagtgacgtgctcagtaaaagggttgacttgaaaaaatttgttcattgccaaaaagataataaagatgtctggactggggtaggtatcaaataaacaaactaaaacgtgtttgagactcttgctatgaatatgacctaatggcatttgccatcttaatttataccaaatcccttgcatgactttgaaccccccaagatgagaaatgaaccgaaaaataatcccaggatggtactacttatctgattcttggccaaagcaagcacaaaatctccctggaggaacaaagttcataggacttctaaacaaatccccctattactcatgtttctaccagtggtcccctgaagaaataaatatgcagcctcaggaacattttatgaattgcaattttaattctggtttgagtccctatcttctttgcataatatctttggctccacaccttcctgtgctatgattgctcaacaaaataaagataatttagaagtggacagagtatgcaggggcttactgaacaacagaaaagtaatatccttctatctatggcttatttttagaatgtgtccttaaatttcagtgtttgtcattatcattcacagagcttatctgtattgacctttactatcctttttaacatcttaaaagcttcaatcatatctctgctcttcaatgtcttttcttcaattgttgtaatctcagtttgtctggctctcagaactaatataaccttctttcccatttatcattctggtcccgtcaatcccttctgcctcctcaatgtctttcctgtgacattattcctttccctgccgagggagattgtctgaaatggtaagtcactgagtgtagattaatcagctaccattacaatgtctggcttcccaagacatgtttgtagcctatttcataaatttgttgttcttaaaagcaaacctaatttcacaatgaaactacccaatccccttttcatcaaaaaccagggtaaaaaatgtctttggtgtaaacaacactgttcagctactgtgatctaattggagttagtttacactgtgccttctctaaaatcattcctcttggaattcttattatagtgagcactgctttgatcccttttagtctctttttgtcctccatttcttccctattttgtcctttctttactccttagagagtgcacattcctgtaacataaagcaagctgttggtaactacccctggtattctgtgcacaataatctttgtgcagtgcttttattcttcacgcttgatgtgtggaacaactctgtgatttctgctaatgcccaaataatagtttcctcaaatgctaaatgccatgctcaagctaagataagacgacagcggtcagaataagagctcaggtcttctgatgcttacttttttcactaaaccaagaaccttaaaactagagatctttttgacaacttaatctagtatggaggtattaccaggttcttgctaaggttgagaaattccctttttgtgaatacaagaactgtatttgtgtgttatttgtatatatttgcataatgatttcaaatgtccaatattcaagtacacaagttgaaatgtagtaaagctactgaagtctacatgattcttttaagaacttccttttagagcatctaggaacatcctcatcatatgactcctgaatttctactttctattttttatttctactttccctatgatctctctttagcaatattccttttttttctcctagcttcatagatatatactatcaacttatatatttatatatttaaattgaatattcaagcaagatgaaaggacttcaattctggtaaggaacttatacaaaactaatcttacatagagttaggggtgggagagaataatagcagaaggataatgttcactaagttactgaccaaagtctgtactaggtatatcacatacccattcccagtagacaccttcccttctaacagtcatgaaaagtagtaatatttcacttattttacaagaagcacaaagagattctgaagataaaatgcaattgttaataaatttaaaaggcaggattgaaacccaagtatgtatgattccaacgctagcgccctttccactgtatcaggctgcgtcatgtgataggcatcaccacatatgacatggtctcaagttgctgagcaggcctgggatcctgatcagtcaaccaacatgcattggactcaacccacatatgggatgctaacggatgagactcaatctttccaatcaagaaacttacaatctcattaggaaaacaagtatagcagatatgatatgattaacaaacattgcatgattacttcataatatgcatatgtggggacagggggtatataagaactcttaactttctgcttagttttgctgtgaatctaaaattgctctaaaaaataaagttagtttaaaaaaatctgtcagagttgagtatttgttggaattcttacaacttccaaaacaagtaccctctcgccaatcagtaatacaacccaatgcatacagaacatcattttaaggcagacagggccaccacatacagcctgtgatctaagcaatttttaagaggactttgtttctcagcaacttcagtgtcggcaggctcccctaagtgttgtctcactcagctggatggcatgtgaaccacaaaatgaagtgcagcagctttgcaggttgacttctgcaagaagtgtgaagaaatatccgtggatttgcaagaagtgttaaaaatatcgcaatcggaatattgtcaatcacttctaaatagatactttctcaggaaacatgtttcctttcttgtttctcactctctcttgtggctgggcaaatgtatagtagtttaaggtgttgcaagaggcaaactccacttaaacctctttatttccctagctgagactttgaagaatagaccataaggagcttggggagttatgtgctatttagttttcttcctgacatcttccttttgacttactgcagattttttttttctcatgccaatatatttttgtatgttggatctcactgaggacaaacaagaaacaggctgtgctaatagaaccaagctaggggatatttcaattcagtgttcagctaatagatttagcataatttatcataggcataatgtacctccgattgtatataaataaaattagtccttatgttgaaaaaaaactgttatagtatatgtgtaccttgcatggaagctaagaacccagtttcacaaatgctgtctcaccccaatgacacattatattgaaaaatccaaataccaagccatgacattcaagtaattttcatgaatttaaatatgctgatcaattactcaaaaaatattccagaggaagactatggggttctgtttgattataaagtgtcagaaatatggatctttaagaaacaaaaatcacccctcaattgcaacaataaatctgaaagtctatggcagaataatttgcagaaaacttaattgggcttccatctcttccttctcttccacaacatagacccaaataggtaatgtgcagttttactgtttcctaaatgtaaattccatactcagattctgttttttttttttcctgtcttaagatgaggatttgaagttggccaaagtgttaatcttctagatcctttccttcaccagcaagaatctgactgtagctgacccttcatgaatgctgcctgatttcatccaccatcacattctctatcagtaggctgcaatttatgagttgttcatagaaaagtgaaggagattaaacaaaaatcctactgatcatcctggctacttccaattaggctgtctccaaattgtgcttcattggggtccagaagaggaaatcaactatacaatcagatatttgggtgtgatagtcacaggagcaaagcatttcctctaaaacacaaaatctgattgtgcaattccctgcttaaattctttcattagcatcatcacccctgttttcttcccaaaccctattatggtatggtttctagttagtttcagtatctaaatctagattcttctgaggcagtggtgctatcatatcatatcatatcatatcatatccttgaaacctggaactcctgggctcaagggatcctccggcctcagccaacctaatagctgggattacaggagtgagccacattgcctgggtcagtatctcaattcttgctgagctttgcctgaaactctgctcctggcacaccaatttctacaggctccttcacaatttcacacctgtttcgtctacctccctgttcctcagccctaaatactggtcaccctgatcttctcctgtccatgttcctaaacttccagttcagcaatcatgcttgactttcctgagcaccttttatctccaggtaaaggtgacccttcttccttgtgccctaattgctgtttttgatcagtgatcattgagccacttaatttgtaaatttcttgaaaatagggacacattcttaagcatcttatccatctccgtacttccaactcttgtaacagtgcctaacacattagaggtagtgaataaatatttctataaacactgttccaatgaaggaataagcaaagaagcagttcatctatagaaagcagagattacgtgagtgtatctagagacagccttttgcatgagtgtaataaggaactgtctcctttacttacacagtatgattttaatagtcttgataaaagtttatctgcataaaagttatcttcttatattttatttcaataatctttcctttttgtaaaggcattagtttcaatcattaaaatgcacaaaataaataataagacagtgctaaaaatgggggaaagtactgaataatggttcaggcaacagggcaaacagaccttgcgtgtacccaccaataatgtaataataataacaataatgacatctagaagactttaaagacagtgacaggaaactcaacaggtgttgtaattaggtcaacatcaaagtagttaagttcacttacactgccaaaagtatcagttttatatgtctggaattctaaagccctaaggggtcaaggaatatggccttacgcccagggcaggtgggagactgaaactgatttggagctgtttaaggatggcccgagtttataaaacagaacatagatgaatctggccaacaagtagaagatgacaaagaagcttgtcatctacctcactgtttgtgaagaagcaatttctcatgagaaactttaactccctgtctgccgttgtgcatggaagtgagatctggatttgctctataccagccaaagctaagaatataatatagatatgagtccaagattcacaaaaccctgggactctagcaaaagcaacttaaaactactctacagggacatttacacaatccagggcacatggcactcaaagagtaaacaactccaaccaaaaatgacttctaacaaaaattacattcccctcgaggaagtaagtcacaataagagagagtcagaagatgcaaaagatgagaaaaatggtgccccaaggacaataaacaataaaactgatatttcacatttttgagattcaacgacattgaatcacatagatacgactaggactttcattgaagaaaaacttgctgtgaagttgaagatgaagttactgtgatacataacatgcctcagtgatttcacaaggcttggcttatcagaggtttgtttgattcaagggaaattgagaaggtatgtgtttcaaaggaataggtcagaaagcttttgcagcaaaagtgcctacttatgatgacctctatgggagtctgttcaggctgctataacaaaatagcttacactgggtggcttataaacaagggaatttatttctcacagttctggaggctgggaaatctaagatcaaaggtctggcaagttcaatatctgatacaagatgacttcctggttcacagcacattcttactgtgtcctcacatgatgggaagtactatctggggcctcttttataagggcactaatcccattcatgagagcactgcaatagcaacctcaaagacattttacaatagtggctgcatgatattggaataagtggaacttcttagtgcccatatttacttttgcctcctcagccctggattaactggatatggcttcagtttgactcttcacatacacatttactcagactaccaagtttttattgattgatttccacgtggctgagtggtgccccagcccttggcctctctaaaataattgttctgggtctatattccctttgctttgctgtcttctatgagtttatgtctgcagggtaagataggaggctatatatatatttttttaaatttaattttatgttttgaaacaaagtctcactgtgtcactcaggctggaatacagtggcacaatcatggctcacggcagcctcaacctcctgggctcaaatgatcctcctgcttcagccccctgtgtaacacacaccgtcacacctggctaatttttgtaatttttagtagagataaggtttcaccatgttacccaggctgctcttgaactcctgaccagcctgagcaagactcaagtgatcctcccactttggcgtcccaaagtgctgggattacaggagtgagccaccgtgagtggccaagggacaggaagatttataaacatcttttgcttaaagttacttctaaagaaaatccatgttccatagaaaagtggatatcaaaacacaggtaaatactatttcctaatagcaacagccaagagatggttcaggaacatcattatgtgtaatcacaacatgcccagagtagtctagataatctgacaatttttgccttaccacacatggctctgatctcaggcaccttttatatttagagagtcagctgctttatcccaattttttcttttcttttcttttctgttctctcctttcctttcctttcctttgtttcttctcttctccctcccctctcctccccatcccctcccctcccttcccttcccttccctttccttcccttttcttcccttctctttctttttttttttctttaagagaagcagtttctctatgttgcccaggctggacttgaacttctgggctcaagtgatcctcccacttcagcctcccaagtagctgggactataggtgcacaccaccgtgcctgactagtttttttgtgtgtgtttattgaagagatggggttccaccatgttgcccaggctggtctcaaactcctgagctcaagctatcctcccaccttggcttcttgagtagctgaaactacaggtgtgtgccaccacacccacctttgacatttttaaaggaaattactcaaacttatctaaaaagaagagataaactgagaggttattaatattctttcttttcatggaaaaaatcccttgtatgtgaattataaatagaattaaactactgccagttatttttttaatgtgcattgcttgatacaaatcatttgtaaaatcattattagcatacatcattaggaaggcattttattattcccaatcataattctttttttttaataatctgctgagagtcacaattcagatcctggagattaggcatgagaagttgggggttggtatgaactttgtggaggacacttaagttgctcctccccagtttctgcttccagacttgagaatggggagtccacttctctctatagataccataaccagttcaaaaaggaacaatgcactgtgctgaagggatcttctttcactagaataagaattccaaaagactaataccccagacactttatattactgtttactgcatttagtcttcagaatattattttttttttcctgcatggtacccaacaatgtcatgttagtgtgtattttcttccatatgttttttagtttctttggaaaccttctagatgctgttttgtttagagtgttttgtaggaaaggaatttacaccatttataatagttagaacaagaaatgtttatatgatgtgaatgaattctctagagagaattttacataactgcttcattttaatttcgtaccttgactcacttttttcctcatttttttattatagacaggataaaatgctagtgaaagatcaaaagctaattaaaagtaatcaagaaattttctttctttacatttatttctaacagcaatttaggctcatatcatttgtaactttttgaaaatcaatgtttagcaaattattaccctgattctcatttagggtttaacgatttccttatagatattgttatatgggagtttatgtgtgttactgaaggcaaccctaatacaattaacaactaagatgcactgaatattctgtattatgaaacatcaactacattaaatctatagtttaacttaaccctcactgtaacactaagaaacaagtattgtcattccattttataggagctatttgcattttggattgctaatttcatttactcaacaagatgttgaccacaaaatataccccaggcactgtgctagactttagaagtttaaataaaaataagtaaaaatcttacacttaagattctcagtttattggcatagaaacaaaatacaatttaagcattctagtataaatttctttgtaaacaactattgggcttagtaacacagcaatttataccattttatctattgcttcaaccaacattaatgatccttacatgcaatggttttcaatcatgtaggtcatgtacctcagctcagaaaaaaagcacatcctcatctccagaatacgcatgtctgtctgtaactagcacagttgcacacgcattgcaaggagacttgaggacccctagaatgtcatctgcacaattctgctcacattttctcccatttctaattcattatctttatttctcttggagtttttttcatgaaaatctgatcatgccacttcctttcataaacactgcaaaggctgttgaggcctatagggtaaaaatataagctcataaccatggtgtatagagggattcatgatctgaatacaactcacctttgcagcctcatcctctatccccatctttccacttatgccatcccacatttgctatgcctattattttttgggaaatttttatagcgattgcatcctttttttttttttttttttttttttcataaaatgccttgcctacaaccctagtctctttactgaactatttactcctactgagccctcagggaatagttcaaagatcacccctctggcctttcaagagagttaatgttccctgctcctgattggctcactttcattatagtacactcagttctccatatccatgggttctgtatccgtgggttcaaccaaccacagacagagggaaaatatttttttaaaaaatggatggttgcatctgtactaaacatatagagacttttttcttgtcattattctctaaataatacagtataatagctatttacatagtatttacattttattatgtattataagtaatctagagacgatttaaagtacacaagaatgtgtgtagattatatgcaaatacgataccatttcatatcagagacttgggcatctgtggatttcagtttccgcggcgggggcgggggtctgaaaccaatcctctatggatatcgtggaacaactgtatttgtaattttgtcttgtaatcattcctgaatcagtgatccagagctgcttttgatcagagactatgcctgttgatatctgcatttcaattatgtattctaacacccggcacatagaaaaaacacagacatatttatttaatttattgatataggcaaaatattctttatctggaaagcaacttcaaagttttgcttttcctcccaaatacgcaactcttcatactacttccaagaagtaatgcctgatctctcagaaagttaatattttgtgataaaaattccgaacacctgtgcaggctgtgtttgatcagatgaccttgtgctgtctggactcaggataactgctcacagacttaaaagtaaggtatgttgagctaaagaagccagagaaatagactttcatggtatgatttgtataaataaatttgaaaacaggcaaaactaatctatggtgatagaggtcagaatagtggttatctctgggggacaatgatctctggtaaggggcttgagtgcgctttcttggatattggaaatgttttataacttgattgaggtgactgttaaatggatgaaaacatatgtaaacattccctgagctactaatgaaatactattagaactataactactactaattttttttataagtaaagctggctctgagactttcactatgatatacatcagcaagaccatcattctgattcagctctagaatgaggaagtggctagtgggcttttaaaaggcttgaaatccatttttgcaaaatttgaggcccaccgaagacccactgaagttcacccatggcccatgcactattaatttttatagatgctgtgatggtttaaaagatgttctcatatccaattctttgaaaggccatctctgaagaataaggtctaatttacctctacttaagtgggggctgcactttgtgacttgctttttttatttaatagataaaagctagtgagaaatgatgaagtgcaacttgggagactgtgaggtactgaggattatgtttcattcactctctcttggatcactggtagtggagaaagttagctgccctgtcatgaagacccctaatggagagggccacatggtgaggtactgagtcctccagcagccagttgtaaatcaacaaagcagtcttccttagaccatgtggttgtgaaaccatgtgactgagcttgcgagcagatttcccagcccagatgctgccttcagctgtctgccgccctagtcaatatctctaccataaccttactggagagcctaagccagagccacctaattaaccagccctggattcttgactctggaaactacgtaagataataaatgtttcttcttttcaactatcaagttttgggataatttgttatgcatcagtagatgtttaatacatatggaaaattaagacccagagaggttaagtcacttgggtgggatcacacatagagtcatacttgagattagaatccagattcctctcctataatgcctcactcctaaaactgttgtaaattttagaagagatatatttgtaaagcattagaaaagttttaatacgtagtgagttgtcaataatgttagattttaacttactatttatccttcagaattgacctctactaattacaacccaatatgaaataaatattagagtttatatcttcaactctagtctcgtcattaagtatgtttcataaaaaaatgaataaagagatcttccatccagtgttcaaaagcctgagactatccactttataggagagctgattgaaaacacaaagcacctctggcagagaggttggcattacactctctgtcgacgctcaaaagcttcaggaagagtttaccatctcagaggaatgagaacaggtatcatagtcagagggcatatatcaccttgggaggtagagaaacagggtttgaggaagctctcaaaaaagaaaggcttgtccttttctttgttatggaaattgtaaggagttgaaggatagagctccagaatattgccattgaacaaatagtaaaagaatagaattaggtactggctaacccatggggcatcagtggcactttcatttcttttatattctttaatttgttattgaaaatgaatctattcttatttaatttgagaaggtggaagtttaggagtggatatttaattgttttacagtgtgagagtatgtacacatttgtgtgtatgtgcatttatagaaccttgtctcaacctacaaataactgaattcagaaagatcacaatctgtgtgaaattgctggtctacttctactcctcagaccttcagtaagttcacagagagagaaaaagatgaaaaagtgtcttttgatgtacaacaaactcttcttcccttccaggtagctttgatttggatttgggttcaaaagagggaatggtggggagaaaaagggaagggaaggaaaagagagagagacgttggaagggaatacaaagaaacgacatattagagcaaattgtaataatacatatctcaattgtagaactttattgagaataccaagctcatttgacataaggcaggcatacattttagaaatctctttcatctaatatatattatccaaattaaaatgtgcttttttaaattcccatggactttattcttaagacacagaaataaacaataaagataacaaatacaccttaatagcaaatccacttaagacatattcttatactccaattttattttatattttatgatattttctaaacaacccctgtggcagttcgaattattgttccactttttaagacttcaaaatttcagaaggtttaaaaagagattaactatttgtagcctacatatgaacacaacttccttctctgtatgacaacattaaatgtgtgtgtgcgttcttcacatacagcctaagttgttcctatcatctagttcacatttggtgaacaaagctgagtagagacaagtagagaccctaccaccagctgatctgctaccaaaagatcagcaacttagactatagaaataatttacaagagacaattttaaaatcccataaagctaagcaatgtagggctttgcgggggaggtcatttctagttgcttaatggcttatcttcaaacattgtcctcagtggggtgccctgctatcttggatctgaaataaatatgctctagccaatttcttgagtatttgtgttgcaaggagcatttgaccaaagatcccatcttcaggcatccctcaggctaaaaaaaaaaagccacagaacaaaccgttaacatttttcttcaattgtcaaatagtttatatacagaatatattttttaaaatttaataaaccagcagcaaaaaggctataacaaaaaaagaagaaaaataaagagagatctgaacactggaccaggcattgcatgtaagaaagtattaaaattggaaataaatatattaaaagggatttgacttttttggttatcagtgtgataaaaattaaaatcccatgagatatcataatatgcaaactacaatggctgacttcttagaacagttgaaaataccaagtattagtgaagatgcaaagacataggaattctcataagatataagtagaaatgtaaatggaaaaaaatcctcttgaaattgtctttcagtgtctcctagaattaaatatgtatttatctgtgaccagtgacttcatttctaagtttacgtagagacaatatgtcaatatttcaatgtgtcaatatgtcatctgtgacaagcatgagaattttgaggacaatactaaaaattagaaatattccaaatgttcattaacattataaatatccatttaaaataaaatactatatagcaatgaaaaagcataaagtactgcttgtgctatagatttcacaagtataatattttgtgaaagaaactaaatacaaaataggacatagctgcataaatttccacatttgtagaaatttcaaagacatgcaaaactaatctctagtatgaaaaaccagaaaaatgactacctctgagttggaaggagagagagcaggagagttgcttctgttttttatcttagcggtggccatatgggtatatttactttgttataactcacctagctatatgcttgtaatttgtgcactattctatacttcaaagttcaaaactcagtggacaatgacaatgattacagtgatagtaactaccatttttgaatgtttcatgcctgtccattacaataaatacaatgaattagtaaattcttataataattttgctagaaacatattattactcccttttgtaaataaagatactgagagtcagaaaaaaaaagatgtaactgagaatcagaggtaacagttcagatctcccagagctgaaaattggcaggaccagaattctaacacgggtttacctgagtccaaatcctatcatttttccttcccggcctcattgttaatagacatgaatttagtttctagtgcatccaatagagcttctaaattgataaaagatcaagctataaactatataaaaccataacatcctttactttactgtagtatagaaaaacaaaatgcacctgggtgttttatgagggaagttattccacctgaaggagaatatgtttgcatggcagcattctttacagagccctcctgccttctcatcagatggctgaccccacctgacctgctaatcagcagggacctacatcctctagagatgttaagccatataagatattggttcagacccgttggattaatgcttagtcaggctgtcttctgggctcagattttctcccaattcatgtttccctttgtggatgttggctccatgctctgtagttcacttcccttgcttcctcacaaccatcccaggctctggaaatcttcctttgacttttttgggagaggattttggactagaactagtaatagtattcatatgctactactagtatttgtggttacttttaatggcaaaaaccacaattacttttgcactaatgtagtacgaagacttataggaagaaattgcttattaaacgtagggtgcctgactgaaatgagcccataaaggaacttggaggtaaaagtgatgaactctcctaagaagcaattgtccttactttaatcagcattcactgtgttaaaattccaccctaggttgatagcacatttctgagtttttgtgaggcaggtaagatgtagtgaaaaaattctgcccacttattgcccatgtgaccttgagaaagctacttggcatttttttgtttgtttgctttttgttttgttttgtttgagatggagttttgctctgtcgcccaggctggagtgcagtggcactatctcagctcactgtaacctccacctcccgggttcaagcagttctcctgcctcagcctcccgagtagctgggactacagatgcacgccgccacactcggctaattttttgtattttagtagaggcagggtttcaccgtgttgcccaggctggtctcgaaccccttagctcaggcaatctgccacctcggcctcccaaagtgctgggattacaggcatgaaccactgtgccccgccgccgcttggcgttttaaacctcagtttcctcatatatagagtgagggtaaggatgtctaattttttgcctctgtaacaatttaatgtctaattcttatctctgtaacaatttaatgagataaagcatgtaaacatgctttggagtattttatgttttcatgagtcaattcaacatgatctgtcaaaagaggttgattgcactttctcctagccaacagatttctagtgaagtgtaccttgattgtatctgaggctgagcattttcttttaaaaagagctttgtaaaaatggcaatattctttatcctttacttaacagcggtaattgaaacagagtttcatgatccattgaaactctgaaaatgatcagcttattctgtgggtgttatagttgtgagttgagttccagttagattttataatatatagaataatattagtattactatcatacctaccattcatggactttatcactattcttatttatttctcaaaacgatcctaggaggtgctttttaatatttacattttacaaaaggagaggaatttggaatcctgcgcaagagaatttaaggaaattgggcagctaatgagagccagaatgggatttatattgagtttgtgtgactctccccacatggagtctatctgcatatcccatcctttgtttgttacaaatctcaataggagtagcatctgaagacttacctgtgtgtatgcagtgtcatgataactagttgagaaataaattattggccagacgcggtggctcacgcctgtaatctcagcactttgggagactaaggtgggtggatcacttgaggtcaggagttcaagaccagcctggccaagatagcgaaactctgtctctacttaaaaaaaaaaagaaaaaaagaacaaacaaacaaacaaaaaaaccccacagaattagccaggagtggtggcacatgcctgtaatcccagtaacttgggaggcgggaggcaggagaatcgtttgaacccaggaggtgaagctagcagcgagccaagatcgtgccattgcacttcagcctgggcaacaagagtgaaactccgtcaaaaaaaaaaaaaaaagagaaagaaagaaagaaattatttagttaatcactaggttattaagtgtacatgtgaccataccataattttgacagatttcatattttattcaaattgaaagtgggtttatatttatattctgacaaaccaatttgattcaacagattattcacgggaataatcaaactagtaatttgatttaagaatagcaataatatatttgatttgaaatgggactcacattttctaaaatcagtgccaaacgtttctcccacagtacacaaatatgcatctacaaatgtctcacagtggctctctttggatctcctgcttctctgtgcctctaccaatccacctatctgggatctttttcctccccagtgattgtgggcattattctcttctcagccaattgttttgacataacctaatagatatttaactgaattcctgaaactcatctcttgttttcccatcaattaccacgatttcagggctaggctagaccagggcttctgaagcattaattatacatatgcatcatctggggatcctattaaaatgtagattcttactcagcagacatagggtggggctcaagcttatgcatttctaatacagttttatgcgatacctttgctactggtccttagaccatactttgagaagcaagggtatacatacaccacattaagtaatagactaattcattataaagaactttgatttgattgctgagaaacctggctttttatcccaacctacaggaattaaccacataagctaattaagtcacaaattccctaggttttcatttcattaagattaaatgtgggctctatctatcttagtcactttccctgctctaacatggaattttcacattaaatataacaccactactagttacactaagttactgagtatctaccatatgccacatattgcaccagaagctacgcctgttatttctttttcatcttcacgaagactccgtaacataaactccatggcatcattttaaaataggagcattggggattacagaataaacgccttttccaaggccacagggtgattggtgctagagccaaaattttacttgaatgatttgtaattttccatttaaaattatattttatatgatttattgtctagtttgtaaaggcatttttgtataagcatatatatttgatcttaatgtcacatatttatttgttaacatcttggccaccactttttcacttaaaaaagctgaaattcagcattaaaaataaaatttgtccaactttaacttcgcctgcataatgagacagagaagatagcctgtgatatttagtgacaaaattaatgaatattaccatcttctttttgcttcagctcacatctttatttttccctattgtttttactttttggatgacaaggcattctccagattcaaaattcaaagctcatttaaagagtatttaataaaaagaatccctctaaatcctgtccctgagccacgagctgctcctctccagaggcaaccaatattcgactttaaattcatcctgaaataccttatgcttatataagcaaatctttttctttttttatctattcatgtgactctatatttttacatgaggagctagccgttaaacccaggtctcttttcatcaaaggtccacgctttcaaactttacaacataaaccctctttcttatgaatacgctatttgtgtgtagatactgtattacaaaacaaaaatacttaggtccaaagagtgcctgtgacatgaactccactcgttgcttcagtcctgggtcgatgggatgcaaggccctgccagaacagagagtaggcagactgtacccctcccttcttagcacactgctcacaagcaggtgggcacagagtctgcaacagcagaggctgcacaactcaaggaagtgattctgcccaactcccacatgacaaccacaccaaacctcgagtaccatggctcagcagtctacaccatgaagactatggcgaagactttgaggtccttttctcacaaaagttaagagtatcattctcaactgaatgaaaagtaccatatattttctaaaccaccaacaaatgcatttgatttaccaataaataaaatattattatagtggtatttattttttcactcaagtatcaaagctactcagtgcatgagtttaaacaagttaaattttgaactacatttatgttgaattttaactcaaaacacaggaaaacaataaacaatgccagataaggttgaattaacaagccagctgatttatttttctagcttctggggccagttgctggtggctttgttcattctataggtttgcaagtatgatatacttcactaagcaggatctggtttgtatatcttttattttttctgatataacctcttctacaaaatagcaaagtaacattgggccagttccttaatggccaactttctgtggtcattcttttcagcatgtgtaatacaaggtgcttaaagtatggatttcctttataaggaagtaagaaaccccgagaaaagagagattttgtctccatcacaaaaacaaaacaatgagtgaataatttttttaaatcagtcaattcaagtggtacatattgcatgaatccaagtgtttaattaatattttcatcatcagcccaatgaccttcaaatcttttattaaaaatacctgtaaattcacagtcaaacccagaattttattacccatttcaaaattccacttctcaatataacattattatagagggaagcactagacagagattgcaaagtcagtccagaaaaacaaaggtaaaatgaaatggacttttaaaactctgcagatacagttccatctggaaagccatcacatacaactgtccaagtggaaaaaaaaaaataaaaaaggactgagcactccctactcatataagataaaagaaaattctttttctaccctaagattctgaaattgcattttgctatttccttccaatgttagaacagtgtgatccagtattggtggcatgtatgctagcagagtggaaaaaaaaaccctccaatctcacactcgggaagctgatgctgacaacatttttggcagatggactgtgattttctctcctgtgaaaccaaacattccaattaaaatggttctctgatttttgagcaatgataaaagaaaaaagaagctacatgaggagcagacagaaaagttaaacctaaaaaagagcaaaaaggaaagagagataaagacaggtgagaaatatatatcagaaataaatgtgaaagctatacaacagataatcagttggaaaaggagtaaaaggagaaatgtaggctgaagattatttaaatagaagcaatgtagtagaagcagtgatatatggcaaaagtcagtctacaatacatgaagtttatttactctggaatacacaaatttctcatttcactagctgttttaagcccagttgtttggtagtgtgtgttgaagttttcattttaggaccaaaaaaaaaaaaaaaaaacccctcttcttttattttatggatttattgtgtggttctctcagctattcaataatcatgaattaaacactttgtgtatgccattgactctgtggtagaattcgcagtacatatgtgtttgccagggaaaaagtgtgtgtgtgtgtgcatgcacacgcacacatgtgtaggcatgtaaagaatatcttaaaatcaacatatttttcttgattttctaggttaactaggagttctcagtgctctatgtgtccccttgaaacaggtattccatgccttgatggctaataactctcaagataattgaccaacttcatgggtaaatagcagggaagaagttagccagaatctgattcctcctgggagagaatgctgaattgttgtactgtagacttaattattctgggaaacacatttctaggaatccctttcctaaatgattttctttatttctagggttagagtcgatcaaaagtaaagttgggtgggactggtgagatgaagtgaagtatcagacgtcgtgttctgaaattcccattagttagtggtggtgagagacttacagggaggttttggtgggttcccgtatcttcactcttccattctccactaccagatctccttcccaattgccatcctgaccaacaatgattggtctcagatccaacaccagacacatggctgcaaactcgtagaggcagaagccacgaagcaccaaaggctttcatggacttcttcatgtgtgatttgacacaggatgaaatagaattaaagggcaactacttctttaaatactggaaggctgtgaccatggttaaggatagcacatctgcatttccatctatttgtttacaattaaaagaagaaaatagtatttttattagcagtgcaatcccctttccagtgcttacctttccctgtctctgccccttgcacactaagggaaagatatgaatgaataatttgataaactgcttgggacagggcctgaaagcctccaagtcgagcctgtgtcatgcaactggctgctaacatgtcttctggagaatggagcttcaactaattgaaggacctttgttttgtttaggggatattgtatttggaaaccattaaaatgctaagacaataggggatattgaaaataacatttttgaagaaatgcaatgaaaataaggaaggtctcttagagaaacataatggaggaacagaaatgtcgaatacagattttattaagttgtttgcagtattctatcagatatgacctctctttttttccatggaaaccggtaaaatctacatttctcactctttggtggtgtagatttactttatcaatgtgaaatttgcagtgaatacaaggatggataaacaactcttgagtgcttatccaggcactgctccagctgggaatatggtgttgaccaagatggccacatctccctgtcagtcttacaaccctgaagactatgaatggagacaacaatattaacagctcacagtgcaggcataaaacaagtgttattaaaggaaatagggaagaaaatcaagagaatgcacctagtcccacaagctcttaccagcccactgagaagtgtgcttgatcacatcaccatgaaacattccatgattgtgatcctagaaagggaactcatctctgtgcttctttacttatttacaggaaacttggaaagagtcaggaagcataaagccagcaatcaggtaactggggagatgtttggcctgtgaaacaatttgctagaaaaacaaatatccggggcttgaacctacaaacagattcactggagttaaattcagagggatatattatgatgtccaactgcacagtggacctaaccactaggtgattatgaaagtcccctatattaactatggaaatttggcttcagtactacctagacaaatggtgcttttccatgggtagaaccttgccaagatcttcacaaagccattttcacagtttcctcttgggaaacaacggtaatcctaataataacgtaaaagatctctttatgaaaaaaaggtttctgtctaataggacaggtcattctagcaaatagtaaaatctggggaaaacatacaaagaacagtaactcacctagatttgaaaagtggggatgggcacgttttacatttattctaattgtaagcaaaagttgcgggacatctggtactatggaaacagtgacagatgctagtaaagttgtgctgtgattataaattgtattttcatattgaagacctctaggtgtttacatacgctggtagagttcagtttcactgcagggatctcagaagtagggtgaggcattaagccctgaatattttaattggtctcaatatactaattggtctgaaaatgacagttatgtaaaaatctcagggtcagagatctgcattatttactggtgaaacaagttttcaattctttaactagaataaagaaatgagtatttgctgagtgacttgcttgcagaaaagttgagataaattcataaataaatctattacaaagcctgactgaaaacgaatggcttactttacacattaggacttaaaatgcagcactccatatgggaaaggcattcttaatctcttcattgttatttaatttaacatgtggagcaacaggttcattaatcacttcatattaatattcaagtgagagtgaagatgctgggacacgttctattccaaatagcgattctatttggctgggcgttgtcttaggcatgatggagagggaacaggaaggaagattaactttctgctacacttatttctgcttcattatcctggaagtcttttatgaaccattagtaatacttaaccagggtaaagccaatcttgatgtctgcccaatttaataaacaaaacctctttaatttaaagcttatgtgttggccagacacggtggttcacacctgtaatcccagcattttgacagtccgaggtgggtggatcacctgaggtagggagttcaagaccagcctgaccaacatggagaaatcccatgtctactaaaaatacaaaattagccgggcgtggtcgtgcatgcctataaacccagctactcaggaggctgaggcaggagaatcgcttgaacctggggggcggaggttgcagtgagctgagatcgcgccactgcactccagcccagtaacagagtgagactctgtctcaaaaataaataaataaataaataaataaataaataaataaacttatatgcttgtttattcaaaacagtcatatttacaaatcatgataagaaagaatgatcatttatttcatcctacattttctctcatctttggaggcatatggtagctaataagaaaagaaaagaaaagaaaaactactatttattgagatcttgagctaggcctttgctttttatttgcattgttatctaataagttaacatacatgtgaaaaaaaaatcttctcttctaatatactctctgaaaactggaatacatatagtgaaacataagaaaaggattatataacttacaatagttaggttgcctgttgaaagtttagattgttattggtgaatattaagcattatgaaatattaatggtaatgtgttgtaagctttagaaagttaatcttatttaattctcatgatggctctatgaggtaaatatttttattcctatttaatagtcaaggcagctgaggtttagagatgttaagtaatttgcccaaggtcacacaactaataagtgttagaggtgaaaaataaaatgcaatgcttgtgctcttatacatgcaaaaaattgcataagtagtctcttcagtaaatttactatgcagcatttagtagcctgtaacctaaaaaagtaagaatatgctgtgcttaaagtccaagaattttccaagacctctttggttgttcggtgaagcctggagaaccccctcaagtatatctaaggctagttaatagctcaaacaggatcatattcacataatgcaggctttatcttttgctgccttgttaagattcagtttgagcagccttccaggttaggggaggttgtcattggttcttgccttgacctgacatatagccatcgttcatttccaggatgaatttctgttctgtattaatgaacaaggtgcagaacatgaaatacaggactcattacatttcttggttttcttcaagatctttgcttacttctggcttaaatcaaatgaaattgttttcctgggtcttggtgaccctctaaaataaggagactctttgggaagctcagttggcagtctgggttgtacagaacttttagctcactcctgcctctcattttcatcacagaagatcctcaccttttgagcatcttattcaatacaatttgagttatgggaactttttaattaccctttctggaaccctttgtttgaaatcttcattttagttttcagaagataatgcaatcaaaactggacttattttattttaaatatcttcctaagtcccttctttttagtaacaccaatactagttatgctttttagcttcttctgccctctaggtagaaggtgtcatccaattatgtcgctacaagtttccttatgtctctttccttataagttaaaatctcattagattttatgaaaagtttcagtaatatgcagtgtattgcaattacgagccttggcgtctgtcttaatatgatcttgctcgaactttgaaaatacttattcatagctgtttgcctcattatgcaccaagctaaagcttgctaaaactgaaaccattttcatgcctccacgatgtcatggaaggaagtgaggatctcctagtagatttccttttttccttctaaagcagtcaagagcacagcaagatgttgctgaaggtatttaaaggaaaatgaggtcatggtgtcaccagaaaaggtcactgggctggcttccgtgagtcttcacatctgacactcagctcctcaggctcagaagctcagtcttgacaggggtaacccagatttgattagatctgaatatggagttacattacacttctcatgaaataattttcaaaacaagaatgacaagaaattaatttgcaatgaggtagataactgccagtggaatcagacactcacatcttctggtagatattctcttcttgtaacatagtaaatgaaagccaaatcatggtcaaaagttgcttagcattttaacaggtgcatcattatgatttgaatacttaagaccctcaagatagcacaacctgatgcatttatgtaaaatgtgcttgttactaagaccatataggctgaatccttgattaggcctccttctcccagggcactgcttaaacagacattgccagtactcccatgttctagtactaaccaatccattcttctgccctacaattgatttaaaaagtagaactttttgggaccattatattttaagtggtttttgttaaaaggactattgtatcttaaagtgactctgacctcatccgtaaggtgttcatttgtagttattcctcttaagagtaattttatttccccatttcaccacgttcacctccaattcagtgcatgatggtgcactggaaagagtttatcacaacaggagtcatgaggccaactccaagagacaaggaatacatatacaaggacacacacttggtacggtcagacaaataacaggatgtttcactttgtattaaattaacttgggataattcccaagatccaaggtagatctcaaaaatgaaccttctaggaaagaacaaaagcatctactggaacctggcaggaatttcagggacgcttgttctagaactcaagataaactttaaaatggaagtacaaaaacaattctttttaggaaaagaattgttaagtgaatcttaaggcatcagagcatgatgcttatgatcatgagttttagggtcaaccagagctggctctgccacgtcttaactgtgcgaatttgattagcttcaataaccggagcctgtttttctttatctgcaagactggggaaataagaatgcctacctcacaagggcaggagggttaaaaaaggcagttcatgaaaagattgaattcagtatgtgtactgcagacagcactcagtaagtgaaagttgctatttattggattaaagggttggttttattttatttaagaaggattatcaattgagggcttcagagcaacactgtactttatttacaaaataaaaatatgcaattgggaattagtttcagccattacgaactacgaaatattgtgtacatatatatacatatatatgtgtatataatgcctgtatgtatatatatattatgtttatgagcatatacgatacttaattgtgaaatgctccttaactgattgtgaagcaggtttattgcgcactgtttgttgtttattgtgcactggctcccagcttgtctgagtctggtgagacaaaacacactcatatgcaacaagttatatgaagtggattcatttcttacagataggcagcaagagacagcagatatcaaggattcattgtgaaacagtccccccaggttcagaaaactaccaagagagatggagtctcaagtccactggcaccatttatactgctgaagagggatcctgaaaggcagccaaccctaggttatataacttgtggtcacaggaatcacggggctaaagcactgtggacatcctctttttaggtgggaggactggaatggaggccagactgccccatctagttcctccctatctcagggcattgcattcccagcacattctacaattattcttgagaactacaagtgagaaaaggggaagaacagagcaggtccaaggtcacacagagaactgcctagttgcaacaaacacgtatgccacagaaatgaagcagtttaagggacggcctccagaacctgaacgcatgcttttcagtgctgtcttcttcccttactggctgtatggacttgggcaacttatgcggtctctttggacatataaaaggcttgtatttaccctctacgtttctagatttgaaccctgtaaaatgatcaccaggtaggaaaagagtcacagttatataagaacattcagaattacattctctagtaatctaaattaatcttatctctatttgatagttttctggttctctcactatacttgggcatggatctcaacaaaaaatactgcctctctgggcacatgatttttgttctttacaataagatatagcataatggctgacttcaattcattttccagctatgccttattgagtttgtgaccttggacaaacttctcaaaaccttgattttctttttagtaaaatggttataataataatgaccctttcataaggtttttgtaagaagtaaatggtgtaatgcatataaaacattgaatacatatttgacctggaggaaatattcaatgaattctattttttattttagtacagaacatacaacagtgattgtaaacagtattgagtatggaaggagaatgtgtagtgtaaaaaaaaaatcctccatttagtaataaattattttatctggggaaaaaaatcaggtatattttaagggcaatagaagctacaaaaagtagtcaggtagaaagggggaactcttggctgaaggacacatataaaaggatgcagagacattaaaaggtgaagatgtcaccctagaagtgagtgttacagaatctcaaaaaaaatattttgataatatcacaaaagaggatgagtttctgtttttactaaaaaaaatgattccaatggtcaggtaagataagatttacaaataatggaatatctttattaacccatggaactaatgcaaagttcatttttattttagataaagtgcctattttacatagatttcctcttaacagagaacgtccatcgggatcttttcatgaacagatagcttagcaagcttagctgggcctgttgtagaacttgttgattaaatgactgggaatcctaaaagggttggggtagtgtctccgcatggtcagaggtgtcagtgacatctaccctctttttcttttcttttttttttgttacttaatttaagcagcatccctctgcttttctttgtctttattaattgtcctttgaaagatggtaaatatatggcttctccagttgtggtctttggtgctccttcagagaaggctggtatttaccctctagctttcccgatttgaactacgtcaaataatgaccttgccccacccagctctttttcttttttggagaggttgtcaccatgagcccctttggaaaaaaatccatctttctctattattgggggaaagaacactgaagaaacaagactttattcccatgaaaaatttacaaagaaaatcaagaattttttaaaaaatttgaatactttctaatcaaatgtactatacacatcaggaaaaggaaaaattaaactggatctattaggttggtgcacaagtaattgcagtttttgccattaaaagtaatgatacaagtaatttgccgttacaaaaactgtaattacttgtgaaccaacctaataagagtcttagagaagatctaataaaggaagcaaaacttaacttctactttgaaagattaaaaaatgctaacccattatactttgagttcttaagatgttaggatgtgtctggatggtactaagtacttatttttatttttttaaaataatttcaacttgtgttttagattcgagggggtacatgtttaggtttggaaaactacaaagcctctttgatatggatgaggggtccccaacccccaggccatggaccagaactggtctttggcctgttgggaactgggtcacacagtaagaggtgagtggtgaacaagcgagcaaactttcatctgtatttatagccactccccatcacttgcattactgcctgagctccacttcctgtcagatcagcagcggcattagattctcataggagtgtggaccctattatgaactgtgcatgtgaaggatctaggttgtgagctccttatgagaatctaatgcctgatgatctgaggtagaactgaggcagtgatgcttgcccagaggaatggctgcaaatacagattaacattagcaaagagctttgacttcacagagaccataataaatcatttgcttgcagactgttctagttcattttcatgctgctatgaagaaatacccaagactcggtaatttataaaggaaagaggtttaattgactcacagtttcacatggctatggaggcctcaggaaacttacaatcatggtggaaggggaagcaaacacgtccttcttcacatggcaacaggagagagaagtgctcagcggagggggagaaaaacctttataaagccatcatattccaagaaaactcactcactatcacaagaacagcataggggaacacccccatgatcgaaatcacctcccacaaggtccctcccccaacacgtgggtattacaatttgaattacaattcaagatgagatgtgggtgggaacacagagccagatcatatcacagactcatatcaaaacccttttagtaggtggcaggtaacaattaagctgcccctggtggcaggctttatagtgccaagtgagttcaggtacttcaattgtatagctacatctcatggcaggctttatgtcagaatctgacatttattttagtttgcacatggcccacccattattttacttaccactttcatgtacatctcttttttccactgtgcactcatctccagcacgcttttggtaagcccacaagctaaccctagccaaaatgggtatagaacaaacatcactggagatcttccttgcaaagggagaaagaccaaataatgagagagcagaagactctaagactgccaacaaaaagaaagctgcatttaaaggaaaataccaagggtcctacataaattacacgttcattacaatagttgattcacattctccaagcccactttgtataatatgtggggactagctatccaacaaagctgtgaactctttaaaacggcttcgccacatggaaaccaagcaccctgtattaaatcacaagactttggagtttttcaaaagaaataaacatgaaaacagagaacagaagcaattatcgaaggccaccatttcatcaaatgtgtctgcactgagagcatcattcttaatggctaaccacattgctaaagtaaagaagtcctttactattggtgaagagttgatcctgcctcctggtaataatatttgttgttaacttttaggagaggctgcaggtcaaaaggtggcacatgttcctcttttggctggcaccgtaactagatgaattgatgaaatggcagaggatattgaggcacaattgctaaagaggatgaatgagccactgtagtattcaatccaggttgatgagtctacccatgttgacaacaggtaacaatgcttgtttttgtgcaatgtggcttttaggaggatgtgcgtgaggataagtcatgtgcattttgttttgccaaccaacactacagctgcacaactattcaagtctttgaataattatgtatcaggacaactgaattggtcatatcgtgtcggtgcgtgcatggatggagcagctgtcatggctgcgtggctttctggtttcactgcttgggtcaaagaggttgcttctgaatatgagtctacgcactgtgtccttcatagagaaatgctggctagccaaaaaaacgtcagcagaacttaacaacattttgcaggatgtgattttaaaattaacaaccacgttaacgtacatgcccttaactcacgtctgttcatgcagctctgtgaggagatggacacagagcaaacacatctctcagacacagaagtgagatggctttctatacgtagatccctggccagagattttgagttatgagagccacttcagaaatagcacatttcaatgacacagaatgggatacaaaacttgcttacttatgtgacatattcaacctgctcaacgaactcaatctgtcgcttcagtggagaatgaccactgtgttcaagttggcagataaagtggctgcattcaaagacaaactggaattatggggcaacaagtgaacatcaggatttctggcatgtttgaaacattagcagagattttggaagagatggagccagaggcttctttctcccagcttgtgcatgatcacctaattcagcttacaaaagaatttgagcattacttcccaaccacagaacacccccagactgggaaggaatggatccgtgatccatttgtgaataagccaagtgaatcgactttgtctgtgctagaagaggatcaactgctcgagatcacaaatgatggtggccttaaaaggtatgtttgagacaacttcaaatcctaatcatcaaggtcaaataggtgtgacaaaagcatccaaaagcctgcttccatttccaacatcctatcttggtgaagcagggttttctgcagtgacagcaaccaaaatgagattacggagtagactggacataagcaacataagcaacacatttcgggtgtcactgtctaccatcacccacagatgggaccatctagttgcaggaaaacaagctcagggctcccactgactctacattatggtgagttatatatttatttcattattatatattacaatgtaataataatagtataaagtgcacaataaatgtaatgtactagaatcatcccaaaaccatctccccaacccctggtccatggaaaaagttgtcttccatgaaaccagtccctggtgccaaaaaggttggggactgctggtatagattatattactgcctggattttacagacaaggaaattgaagcttattattgtaacttgtgtctaaagcttgtgaatagaggagcaggcttttgaacttggacattttgtatttagccacctattcctaacatctcccttatactactagagagaaggcaagtggtttctttgctgttcaggtatatgccaggttcaacagttcccaatgttacctctttatgaaacaacaatggcaaccaaaacaaaaaccttatgccacaattattctgtcatctggatgttgttgtattcttccatgctaaaagggtagctttgtgatataagttggaattttgtagcttgcctttacttgtacactcaatgaccctgaatcagaagaagtagctatcaaaggtttgagagttatctgtgccaatgatataatgcttttcttcaaggtacattcattcatcagatatgtattgaatcccataatgggaagggcattataaagttgggtgggcatagggagaaatatttgatgtagtttctactcacaaagacctcatagccatttgggacagcagaccacaaatgaataaattacaacctagcatagtgtgtgccgtaatgtaagctgctagatactttttttcttacttcaacttattgcagaactaaaaccaatatcttcattttggctctgacttggaataaatcttactctgcctcctgggacagtgaaagctctgttgagaaactaataagttcggcccaaattctcagcagtgtgcttgatgaaaaataacaaattttgagaagaagaaaagaagtaaggcagttcagcttactagaacttgatccaaatattcagagaaaaattcaggctttggttatctaaacaagcaggtggagacagttaagaaattagcataagttaaataatgaaacattcattatttcacaattgaattactaaaatccttggcataaacatacttctatgtcacatgctattttattgttgctaatagaaaacagtcatgtataatttagagagatactttaattagaatatcaattatttccaaatatataaaaataataacaaatagacaagggcatctttagagccctaaatttcagcagcactgtatgtttagtggaatgtgacactttagaatgagttttcagacattccaatatatttctgtactttggatttttatagagtggaatgccttggtcattttttagagttttgatagtatattcagtattcttgcaaactacggataaagtaaatgactgttcaaatatttgacaagcactttataaagaaaaatatgaatgatataaaatagagaatatagtataatgaaaaggcacagcaaataccttctgttatatacactcatatttctcagtctctataacgatcctctaagatattatgcaatattgggagacagatgaattgacaagagatagtgaaaacgatatttataatggcatcaccagcagagcaggaaaagccacagagcagagcagatggggaataaagttctttgttctattcggtggacttccattcacaatttttcccataatttgtaggtggacctcattcagcctgcagcttccctctaatcatgggaggcagagtagcaaattggacaagctctctgtgaattccaaaagctttggatctgaactctggccctgccttttactaacttggggattttggacaatcagtttcatccttcttttacaaaatgagaaaaatgacgtatgcataattcctatcattgttgtaaggattaaatttgatgacatatgccatgacaagatttttctccctactttaccagctactcaagccctaaaccagctgtctccaatttctcatctttgctcaatgtcctcatgtaatccacaggaaagtccaactaactctgcttccaagacaaatcttgtatctgttcatttttctccatcttccctgataccttctacaccaggaattcttaatcttggaactattgacatttggagtcatgatcagctacataattcacaagacccattgcgaaatgaaagtgtagggtatcttgttcaaaatgaaggaaaaatatgaccctaaaggtactaaagtgtcacgacttttcctttcctctgcagtctctctcttgacttgtcatcaggttaatttgctattcaaatataattctaagttttaaaaaatgttaaattactagcatgaatgttatcactcatctttatattatacaatgccagctttaaatgcaaatatatgactatttaacttgcatgcagaatcgccaaaattatacaattagtatttcatagcttgtgtatgtatatgtattttgttcttaccagaacagtagaaacactgcacaaaactaattcaactgctttcatttaacttcctgatgtgtgcatattctaaattcactctgattaagaaagaagaaaaaggaaaaggaaacaaggcttatcctatctttcttccactttccttcaatattattattttcatagtaagtagttggctaacacagagaagtaacaagtaagaaaggatacataaggttcctaagcatgtgtgtttcttcgaaagccttggcctactttctccattggaagccatttcaagcagaaaacatagatacttgaggcctccggtcctgcttactcaatcacagatgtaacatagtgacattgaactcactgtgagccttgtagaaatcccacagaccatagatccgctggaattctgtgctcattgtttatggccaacagtgaacggcggacacacacaatgcccctgtctctatggcatacaggcatgctttattgtcccaaaggatttcacttacaaatcataagttccatgataataatttttatgaaatgtcaagatgacaatagcatcacgataaatctagtgtggcatctttgagtgtgggtgggaccctgtggagtcatgaagccatgaagctgtccccgttaacatgggaaaattctttttgtggggggctcttctgcacaccatatgatgtttagaaccattcctggcctctacccactagatgctagcagcagtgaccaaaggtgaatatttaaggagagaaatgttacaactccaatgtctctttggccatttttaatactggaatagtcaaagatctggagaaagaaggctgctgggaatcagagtgccccactctctacttatgtccagatgataaattaaaatggaaatgacattaccaaaaaaaactttaataacaagaaaagaagaaataaaagcccttaagaaattaatcaataaagacttcagaataggaaacatcaagatgattttaaaatgatttagtcaaacatttgccaagtgtgaaaaaagtcactcaaacggattgattagctgaatttatttaagacagttgagctcatctcctcttagacacaatctaaagatccattatacactcatgttttttaatagattcatttatattttattgatacataataactgtacatagttatggggcacatatattctgatacatgcatacaaagtgtaataatcaaaccaggtatttagggtatctatcacctcaaacatttatcatttctttgtgttgggaaatttcaagtagtctcttctaactattttgaaatattcatgaagttattcctaataatagtctctctactgtgctatagaacactaaaacttatttcttcagtctaacagttgcacgtttatgcctattaaccacctcttcatcatccttagcccttcacacactttctagactccagtgtctaacattctactctccagctgcatgagatccatttttttagttgccatatatgagtgagaacatgagctatccatccttatgtgcctggcttacttcacttaacataatgacctccagttccatccatgttgctgcaaatgaaaggatttcattctttttttgtggctgaatggtattccattgtgtatatatgccacattttctttatccattcatctgttgatgaacacttagactgattccatatcttggctattgtaagtagtgctacaataaacatgggattgcagattatatattcatttacaagacaaaatatacttggccccctttatttgtaacatatatacctgaaattttcatgtgaaaggtatgggatttaagagaaaggtgtgtgattatcttttctaggagttagtgacagtttggcaaataagtttttcatctagactactgacttatttatatcctttggatttgaaagaagattcaaatagtagatgacttcacaggtaaattcttttttttttttcattttttttctacatttgtctccctccctacttcttctctgaaattagcatatatttattaaacactactgtcaggtagggcatgagtgcgaaatattttataagacatagtccctaccctcaaggaatttactgtctagctatgattcatgtttttgttatttcactagttttctcctcaatcatctgtcactatcatcactcctattatcatctcatgaatatcctaatttccctttagcactatattataaacctattggaccaatttatctcaactcttttaaaactttcacttagtagtctccaagaaatttcaggacttgagaataatgaaaattaatatctttaaatttgcaacgtgccttttctttcactgcaaaagcaaacagtgcacaattttcgaatgacttcaaagtgcaaatgggaaagctgcaattgtaatgaggaaaaagaaatcaaataggattcaaatattgtcaagtaagccttcatcgtggtgggggtcttggtgtctttgtggtgattgaaatacttgacagaaaattgaaagaaaaaaaacagaaaatgtgattgagaattgatttaagagggtgacaaactcaacaggacttctaagtcatcttatgtaaaatgctgtggaagacagtgaccacttcctctcactgacaggcggttccctgtgctgtcaatgagcttccctcaaggctggattaaatacactctgggaacttttgaattaggcaggagaacctgctcagtaatttagagaatttagcactaataaagactaagatgattgtacataatgggattgtaggattttagcaatcctggtttagatgacaaatgctaccacgtaaagcgttttatgacaacatatgttataagagattatacttattccctgtggagctttttcacctccattttagctactcttagaatctgtactgaataagggaaataattgaggctgtgaaatttgattcttttcaaacactatggggaaaatgttaaataaatctgcataaaagacatccacaacataaagttgagaagcttagcttacgtgttaatcattgctttgtgctgtttgcaaaacaaccaccaaatttggcccaagacaaagaatattgcctcattaacaaatttggcaacgctacagtgacagtaatcacatttttattctattttcatattcgagacttcaaagcagcttaaaaaatattcattaacaaagcaggttgcagcatgccaaccagtagctgcatcagcatagtcagatataattttgtgagctttacctaggagggcagagtttagctatagccacaggaaatatacacacacaaagaaacatgttagataagattaatgaaaatgttctcttaaaaataaatgagtttctcaatgaaaggggaaaaaatcctgcaacataatttgtcctttggattttaagtggtgtggtcaatcattaatgagaaacataatttaagaaactttacaaagactgaattgttgctaaatacaaatatataaaatggtgaggaaatatacaaaatgtgccaagtttttcaaacggattcaaaaaattatcaagtacattaaaacatttaattacaaaagtaaaaaatgcagtaatatgaatgaaacaatgagagaaatcaatttcaaaacccagtgcgatgcggatgtggtggaattgtatgcattcgtattgaaaagggtatgaaagtgagaaaatcagaaactggtgtctcaaagaagattgaggcaaagggctagactggagcaaggacacgaactagcagctgtcttaagtcagtacttgcttatctttctgatgccagtgtgactgcaagtgtgacccaggttacctaggtttgtgtactcaatcccatatgtctgaaatgaagccaatcttacctgtatattttgtgggtgatgcattcatctatacacataaacatgaagatctaggaaatgatttattttggcttccaaattaaaccagaagtgccaatgtagaggaggatcagtagcccactgtgctcttgataatgggtgatgtgcctcactcataggtctggccattggctggggcaatgggagctattggggtcccatgtggccaacatctggtagatatcttaggtttcctcagataatattcagatgccaaaaaatcatggtcctttagtacatttgttgtaactgattacattgaatccactctgagccatttgaacaccttatctaccatttacctatctatcacctatctttacctatctgtctgtctgtctgtctatctatctatctatctatctatctatctatcatatctctctgtctgtctgtctatctatctatccatctatctatcctatctatctaagtatctatctatgtatcatctatctatctatctgtctgtctgtctgtctgtctatctatctatctatctatctatctatctatctatctatctatgctatctataaactaacaggtttagttagtgaaatgaattaataagacctgaggaataattatgtgacctagactagggtcacattagattatagagatcatgaaacaagttgtttgcatcattggatatgactgtttctcaaagtttttctaatgtcacagttggtactggaaatgttctttcctcgggtgaattcaaagagacaccagagatcttaacagtccatagtgtatatgctgagagcaaataaactgagtcagtaatatacataatgatcatcaaaatccaaacattgaccagatagctcaaggtgttctaaagctataataggcatgtaacacattttctgtcctgcaacaagtatgtaagtatgtgtgtttatatgcatgtttgttttaaaaagtgtatctttttaaataaaagacttggagtcatttataagtaatgcatataatgaaataaaaataaataaataataaaatgaatgccatttgatctagcaatcccactactaggtatctacccaaaggaaaataagccattatatgaaaaagacacacacatatgcttatagaagcacaattagcatttgcaaaaatatggaaccaaattgaatgcctatcagccaacaggtggataaagaaaatatggtatatatacaccataaaacactactcagccataaaacagaatgaaataatggcatttgcagcaagttggatggagctggaggccattattctaagtgaaataactcaggaatagaaaacaaagtagtgtatattctcacttataagtgggagctaagctatggggatgtaaaggcataagaataatgtaatggactttggggactatggaagaagaagaaaggtgggaagggtgggaggggaggtgagggctaaatgactaaatatcaggtataactgggtgcagtgtacactgctcaggggacaggtgcacctaaatctctaaaatcaccgctaaagaacttatccatgtaaacagaaaacccctgtaccccaaaaacaattaaataaaaaaatatgaatgcaggcagagatatctacctcataatctaatgccaagactactggctaaatataaatacataaatttattttgtctaaaaaaaagagaatgcctaaaatataatgaagccaagactaggaaaaatatgaatgaaataaaatgctaagtaaaagaaaggagaaaaaaacaaatcttatatgaaggatgccaagcattcacaatttctatagtttactttcctgatgtctaaagctaaaagagaaaaaccagctctattgggctattcagttgtaaaatgtcaaatttcattcttacatccattctgagaaaagaaaggcaagttcttacttccaaaactgtaagtgaaagaaatgcaagcacagaaaaatcagatgccaaatacagaatcacacaattgcttattgaaagatttgggattaagaccaagcatatcagttcctggccaagtgtatgtttcctaatctcccaggttagctaggccagtagctactacgcattatctggggttagaggagactggttttgcttcccaaatggcaagtgatacagcaatggacaatgacacaagagctctgtgctcgtgtttcttatagtctgtagtcacaggatcacacatggcacccagagaacactcgggactcaacaagtgtttgttgattaattaaatacagtttgcctcctacagcattcgtgatttccagtacaaattaacagagtagaacgccgtgaaagaatatcatccttccagtaagcagctagacttttattctcattgagctaggaatgcatatgaataaacatattgttaaccattgaaacatgctcatttcagttcatttggccatgactctggctcatttttcctggcctctttcaatgtattagtaaaatcccgacttattcatttgactgaggatagcatattcctgagagttatgtgttgatggaaaataaaaaacagatgtgtatctacattactaatcctgctattaaaaagcaactgaacactgaatgatgccttaagatgtgacaaaagccaacctgatctcacctgggctcgggctgggttctgagatggcctcactcacaggtctggcattcaggtggagtgatggaagaaattggaaccctcatttcaccaacatctagaagttagtttagtgttcctcacatggcatttggatttcagaaacatcaggagtataacaagcaaaaaataaaacaaaaccaagaattttcaaacttctgtgtacagaatggttgctaatgggagaaattagaaatactggagccatttttgtctttttttgcagtcttctagaatactagtttaatttcactttttttttctaattgccttgtaaaatacaagtgagttattaaattaacttggctctttttcctgttaatgtattaaagataccttataaatcaaatgaataagaatgtaatgaggcactattatacctagcactaggtgatggcaagaaggaaaaagggcctctactgttttcattagtttatcatacatcatggtttccttgataaatcgtgagattgctgtcaatattttttgtttcttgttttctttttcttaaagagcacacatttattatcttacagttccaagtgttagaagtctaaaataggtctcactgagctaaaatcagtgtattggcgggtttgcattcctttctaaggactccaggggagaattctttttcttgcttttccagcttctagaagccccttcaattcctccaggccacttcctccatcttcaaagccagcaatggccagccaagtttttctccatcacaccaatctgactcttactcctctgtctcccccttccacgtttatgtttttttatttcaataggttttcgaggaacaggtggtgtttggttatatgaatatgttctttaatggtgatttctgagattttggtgcacctgtcaccctagcactgtctactgtacccaatgtctagccttttatcccttaccctcctcccacccttcccccaattccaaattcccaaagtctattgtatcattcttatgcctttgcatcctcatagcttagctcccacttatgagtgagaacatacaatgattggttttccattcctgagttacttcacttcaaataacggtctccaatacaagttggagagattttttatcaaagaaaaactactgctgcaaactgttctctttagacctgggtgaccattgctcatagaaaggatgaagtaacaatgttgacaagcctttgtcaaaccagagctactgctagtattggggttaaggccaggatcaacaaaacgtatattccccacaggtggctgccccttggtatttggctgttctcacactgctccaaagaaatacttgagaccgggtaatttataaggagaagaggtttaattggcttatagtcccataggctgtagaggaagcatgctgctggcatctattaggcttcttgggagccctcagaaatcttacaatcacggcagaagccaaagggggaacaatcatgtcacatggtgagaatgggggggacagagagtgtggaggcgcaggtgccgcaaacttttaaatgtccagagcccacaacccacgaggacagcgccgaggggataatgctaaaccatttataagaaacacactcccatgatcaaatcacctcccaccaggtccccccttcagtaccggggattacaattcaacatgagacttgggcagggacaaacatacaaactatatcacccttcatgcttatgctttctaactgtttaacacttaaagagcatgggaagaaacttattttctattagaaaatttttatctttattaaaatatgagagatttattacacacactcagtgtaacatggcctttgaacttaagtttgctgtcattgttcttttttcgttgttcataaactgagattgttcattactaataccctagatgattctagtcacctaaattctttatttaaaaataatggaggaggtataaaaatatgttcaggaaatatattcatgctactcagtgaagactgtagaatattacgatttagcacatggaatatagaattgacttcctagttgcaatccaagttcttccacttgctatttgtgtcaccacaagcaaattattttaacattcttaagcatcacatttctaatttgaataatagagacgataatttcaacctccaaatattgatgtaagagttttaaaatataatgtgcgaagagttcttaacataaactcaccgttcaataaggtggagctgttatcattaatgtagtttatgagactgttatttccattataaacttataggtctttagatctatgaatttaatcaaatgatcttacttttggacaaatttaaaacaacactgaggggagatgaaataacattgctggaagaatgtacacttttatttttagaactgcatttttaagaaaatatgcagaaaacataattctgaataagtagatgaatatgtctctgatgttcttttgaagtatgaactcctcttctaccttcaattttaactcttacatttcaagtaaaaaacaggtcatccaaagcatcctttatgtcagacacaacactggcagcagcaacccctattactaagctctgttagatactttatcatacaaatatttgaatctcatgttgccattgaacatctcatatttttatcgatatgatgatattttaaaaccccataatagtgcctacaagatagattcacttttaatagaatttatctatgcagcagctaatatagtgaaaagtaccgtgatctatggtatttgggggtggaaaggttgaacctttgtctagcattgattatgaaataatttgcctattaaaactatagagatttattaatctgtgttagcatctgctctttcatttttaaaatattttatttacataaattatcaaaagtctgttatggatatatttgcctctgtgtataaactctcctccctgaagagtcttgtaatagttttctcttctttcttgtgcaatgcctattctgcagtcatgtagtcgaggccttgctctggctgtactcacaggggctacctggaaaagtcattcagttgcatggaatactgagttgtgtcaataaacgctttctcaatagctttcttttctcctcctgccacctgccttcccactccaccccctagtctgacattctcaggttgcattaattctgtctcatgttctctccattagtgtgaattatttgttatattttgctttaattgccatccactgtagtcttttttaactctctccatctaattttgtccattccaccttcattatttctactcttttcccaaatctctcccaaggcacagattccccaggctctcccttattttgctagaacatttagtatgtttcctttaatttttaaatcccagtaatgactgatgcttccaaacactttggatattgggattttaggttaaagatgattcatggtatgaattacaaagaaatgatttagttcaaagtgactggattagtgatttagaggagactaaaatttaagattacttaaggtaggctcgggagaaaaaaatacaaaactaatcataaaattttgcctaaggattatgtcctctttgaatatgttccttattcccaaaacatcctttggctgtaaatatagataattcagttttatagttttacaactattcagttaatttacaactccttaaaagtgaggttagtgtcttacactcactgagaaacatccccaaagtcttgggatttcatcttctgtctttcaagatttatttcattatgaagcaggttgctcaccttccaaaagtggaaatccttcatctgtaaaacagtgttaatgatgtatacttcagagtcttagtatctagggatcacagcagcaaaatcaggaactaccataattgctactagcatttggagaaaaatattccacagtgtattagaaagcagaggtgttggtgttagtgaaaggtgggtttgagtatcagctcatgggacatactaatggcctgatcttacatttgtcacttataccatatgactctgttctctcatctagaaaatgagtatcatgggttaggcgaggtggctcacgcctgttattcccgcactttgggaggctgaggcgggtggatcacgaggtcaggagatcgagaccatcctggctaacacagtgaaaccccgaccgtctctactaaaaatacaaaaaattagctgggcgtggtggtgggcgcctgtagtcccagctactggggaggctgaggcaggagaatggtgtgaacctgggaggtggagcttgcagtgagccgaggtcgtgctgctgcactccagcctgggcgacagagcgagcctccgtctcaaaaaaaaaaaaaaaaaagaaaagaaaaagaaaatgagtatcataatagcgctgtattagaagacaccaatgcctgtgctcagcagagcagtggcatccacattctctttttgtgcatagttttccagcacagagtagaacgcaccaaatgtgttgattaactgattcctataactttgaatatatcattaaggaacacaaactaagtaggtcagaagactatagtagataaaagaagaagaaggtacaattaatagtgatattgacacaaaatgacagttctcaaaaaaaagttcacgaatctgtataatgatcaagattaaagaaaattttactttgaaaactaagtttggtaattatatttagcggcaaaaaaaatgatgatcaaaacacttccagttaacacaaagaatttaaagttgtgattagcttgtagatagaacttgaatttcattttgagaatgattgaagtttgggttaaagatggaactcaaagaacagcaatctgcccacttaaaaagttactgtttccttttttcatattaaagtgttttattctgtaatgacgtactgagagacagaaactcacccagcttgggttaaaaatcatacaggatccccatgtttctcttttcggttcctctttacaatgggcattccactatgagatagcacagataacttggctgagaactcttcatttacacacaagatgcacagcctggaggtatctcatagcccttgtcatggactgaattgtgcccctcccaaattcgtgtgttgaaatcttaaccctcaatacttcagaatgtggctgtatttgaagatctggtctttaaagagataaaatgaaggcattagagtgggctctaatccaatatgactggtgtctttacgagaaggcattaggatgcagacacaaaggggagatcatgtgaaaacactagagaaggatggtcatctacaagccaaggagagaggctgcagaagagctacatccctgacaacaacctgctctaggacttctagcctccagaactgtgagcaaataaatttctgttgttcaagacttgcagtcatggtatttgttatgacagccttagcaaaataagacatccgtgttcacactgtctccagcactggatgtaggaaaatctcttttattatcttattccaaaatttgctcaatatctgaaaggtaatcttcagattcagatctgtgtgactctaaacaaattttgaaattttatacatattgaaattttatacattatatatgtataaaatatatacatatatatattgctaatggtaaaactattacatgaacctagcaaaattatcacttgggcttaccattgtcatttttactactaataatgtaacttttagggttgaatgtaccaacaacacttttaaacattctatataatattgcaagcagttaattttgttgggtagtttcataaggctattttttatcctcctataaaatatttgagtttttaagggaagccccccaaaattgctgtatcagaaaaaaaatggttttgtaattgtgcctctaactctaaaatggaatattaaaaatgatggataaaattttcacaatagtactttaagacatctagaaatttgacagatgattgtcacgattcaatccctttttcttcatgttttgcagtataaagcaatattttaattgagaagcatttgacaaaacagaaatacatgctgtatacctctttatgcatctgttgagatgttcttaaagtcagcattgatttgcaaaggccaagtgccccacagcccactggagaagactagatacaattccacaaatgcttactactgtgtcgaaatttgtagcagttgctctgattttaggtatggatatgcagatgaataagtcatgtctcctttcgtcacagattttacagtctggtggagagacaaacatgtttaatgttatttagcacagtatgtgctatgagagacacctgtatatatcccagggtttatcaccaagtgaaaataagtgatctcaggttgactgataccttagcacagagtaaaatgaatttgaggcaggagcacgttttctaaatgtttttgtgtgctacaaggcaaagagaaaacatactgctcaagaaataggagatagttggggaaaaggcaatttatacatgaaaggtatgagaagcaattctgaaaggaagatagagataagaaataaggcataaaactaccacccactaatcgcctttccccaaaaaaatgaataagcaaaggtcaagatcaggggctttgaaaagagaaatgcttgaactagaacatacacaataggtaaaacatatttgcattggatccacaaatgcagaacaacccccgatatccccaagccaacttttcaaatttttataaaaatagactagaattaggccaatttaaatcatcacttatttgttgttgcagccaacatttggatagttattagcatcattcattcctgaagcatgtattgaatgcctactatgttccacacaattcaataacaaataaaatcaagcttagagccaagtgaggctctaataacttcgaaatggcgatatcttcatctatcctatttattgagaattgtctatgtttagagcacggtagcagggtacaatatagccaaatgctgtcgctctacataggaaaacacaccgagttttatctgctactggttttcagctgccagcagttctggaaaatttgagaattgtctatgtttagagcacggtagcagggtacaatatagccaaatgctgttgctccacataggaaaacacaccgagttttatctgctactggttttcagctgccagcagttctggaaaattgcatcctaatgacagatgctactatttaaaatgaaaactgattttttttttttggtaaaagagactgagagaaaaacaagttttagacaaattccaaagcatgaaagaatgctcatcccaaccatttctgtgggaagaatatctagaatgtggttggcagccaaatagccatataactgtgtaattgcaagctgagtagagaaagagactagcgtcaagtgggagatattccagggacaagtagaaattcaagggaaaaacgcaccgtggggtcacagaataagtcttttcacaaatcctgtgacaaatgctgtttgccacatgtacttaatatctaattggaaagataattctggctgtctttagctctcagggctcttaggagtttgatgtgacatacaggtgttaaagtacgtaaaaaatgttaaacaccagataaatggaaaggtttgtgattaaaaattaagtttcaccgcattgagaaatgccacaagtaggcagacttgcagaagtattgtcttcaaagatgtggaatgagctatgtggaatgaaccaagaataaaacattcctcataattgtgcccatgcttaaagccattgccaccagcagtaactttatcaaaagagggcataatcagtcagaagcaaacaatttcaaatcactgcaaatatcatgtgacccatctgaagagccattttgccacacttttaaatgtgtttttctcctgatggatgattaaataggcagttaatgtcctttttccttgagtgattgaaggacactaagtcaaaattacaatttagacaagacaaggaattctgcactgatgttctaatagcacacgatatttgaaatgatgatttatactccagtccttcttgacaggatgtgcctcatgctgaggatgtctgtctgtctgtctgtctgtctgcctgattcattggcacatgtctttttgtctggacttagtactggttctccatgaagtaggaccctttacaactagaaaacttacccttacccccaccatgtctctgggctgaaaactaatagtcccaccaaaactgtggccagagttgttggaagactcttcctataattaatgtcctataaacttaattctcttcaacaaacattcattagatactaactctctttgttaagtactatagactacacaccacacaaggataaacctccagaaatttatcagctgctaagagagataaaccatgtacatcagtgtggtaagatattttgtattaaccatctgcctctgctacccctcctcctgggtcctcacacccactctgtgtacccagttagatttcatatgccaatttccttggagaagcactccatggagaactgagaaacaacaaaatgaaatgctttgctcttaagttctaatgatgaaatccatggagatcttgatccaaataaataaataaataatctatgatccagcttgttatctcccaactgaaactacacaaaggatctacagagcaggtgaaagaatgaggcagtggtccacattaactaaaatgagcttgataaggacagaccgctgagccccgcttggcaggcgcgtcagtaaccagcatcagggagtcagtggaactgttcttctcctacggaacctcaggtcttcgtgcagataagccctgtacattgcctgtgaaaagaagttctatcagctttccttctctttgtcatttgatgaggctttttaatcactttaaactcccagctcccatcaccgtatcttttttatgtggacaagcctctttccaaaaacccaggacacaggatggagtcctggaccccccaaaaaatggcagtgatgggaagggaaaagtcccacaaccaagaaagatgggatttagcagaagcaactgaaaatcttccactagttgaggcagtgctaaaaccaatgctcatttgacacaaatgttttcttaggcgtattccatggaccaccaatatactgtaaggtgaaagtgtctttattattaaaaattcataattccatagttaagcaagctctcaaatgttttatattctaaatccttccataaatgtctcaagactccaagaaacatatagtaggggaaaattacaatttcccaaatttaaacgatcacaaaattctttgtcaagaaacatcaatcttacagtacactaatgttccatggacaacagtcttgaataaatattatttaccatgaaatatattgcgtatctattatgagttaaatactaatctaaaagaataaactagaaagcagtgttaaccttaccagagacgcagattaaatgttgcagagattcaaaggaaagaaacctcattcctagccaagacgtataggcggtgatttcaggaacatggcatttaggtatggtcttgaaaatcaggcagcttttgaatattggggggtggatgggggaaagttatgctgtgatgagaaaatagcagaacaggtataccaaggggaagagaaccagcatgaagaagagaaagtagcttttcttggctgtagaataggaaacccaaacagattaacagatatgacaaggcagaagaggctgattggggccaaatatggggagcagtgatttcaaaacaaagtttgatctttacttcatagaaataaccatgacctgctccaggttaataagcaaaataatcacacttctaaggcatgactttcacatcatccaattaacatattcatgatgcacatattatcatattgcattcatgagtaacgtagagttaaccctccagttaaaactgtgagacagaaaaaacatattttttgtcactaccctttttttctgctctgtgcaacttcgctagaattaactgtggtcctatcttctgagtacatactaattagacttcctgccacctaagaatctttgctatcctcatttttcttcctcatggatatttttcatttttcctcacctctctctgctattatctatgcacctctccacttttcaattattctacatatttaacaagttcccaagagagaagagtgtccaactggtgcattttatttgacaatagctggtatttatgtaatgagtgctgctatgtggcaagtttttcttgcatacatttatttttaagaaacacacattaataattcccctgtgcaagagatgaaggtaagaggtaatagtaatttacacaatacaaaccagaagttccaatttatgcctgtcagactacaaggtgcattcgtaactctggtaacaatttatttctgggccttcagagacaaggttgcttaccttcctaagtaactctaattaaaacaacaacaacaaagttttaaggaggttgaggatgaaaatttggccttagaaaaaacaaaggattatctaaggtttgcctattccgttcattcaataggccactctgcttaaaaatttaagaattcgctaaacctcagtccactctgttaacaatattcattggaatattaaatgtttatttatttatttatttttgtctaaaggatatttgggaagtatactgtatcaaagcagcagaaaaggagctgtaatagttacttttcagtgtaatactaagcagttaatttttttaaagaatgatttcgcggatttttaaataacctgattttataaggtaagcaaaacctacttaataaatgaaccaagtctaaaatctacctataacttaccagcagaaaacttaaaaataactacattattatatttcaaagtattcttaaaaacttgaattagcctctgtaaaactgtaaaaatacaaaataattgattaaggaataatatataaaagatgggaaaggacatagcttatgagaagaaaaaattaaatagagaaaaggaaatagtgtgatactaattcagttgagtaaaaattcagttattcattgtttttcttaccagaaatatgacagttaggcaaactacttaaactctgtgttttagctttctcatctacaaaaagagatatgaatagttcctacttcctatatagttgttgagaagttacaagtagttcataattgtcaagggtagaggaagtgttcaggatgtagtatgagccatttaagtattgactactattgttactaaagggactgaaaatgacaactatgagtattttgcattttgcttgaaaaataaaacgacgtgtggatacaaaagtattaaatatttgcaaaattcacaatctatgaagaattacacaaatgtggatgacaatggtcgaagaattgaagcactatggtgatcattagagactcaccaaaccccttccttctccttgggcacacagtaggatttcatttctcagccttatattgcaactaggtgagtccacgtgacttgagtgttgtccattggaacatgcacaagaggtatgtgggtcacttccaaatgtaaaatgtcaaaatctcccacagtatccttggtgtgttctcactcctcatatcctgggcagatgccaaaggagatttcactggcattgggagatctcagagacagagagagcctgtgtgctctaatgatggtgcagtgaacagcctccacttcccaacttgccatctcacattttgatcacgtcatgaacattttttgttttaagccactttggtttcgaacttatttttcacaggaattagcctactataactgacagagtaacgaaaaagtattcaaacaggaattgggacacttgtgtccaaattgcctttctcacgtttactaactatgtaaccccagggatttactcaatctctgaattttcttttctttgctgtaaaactcctattataaaagttgtaggtcttcaatccatcttgaattaatttttgtataaggtgtaaggaagggatccagtttcagctttctacatatggctagtcagttttcccagcaccatttattaaatagggaatcctttccccattgcttttttttctcaggtttgtcaaagatcagatagttgtagatatgcagcattatttctgagggctctgttctgttccattgatctatatctctgttttggtaacagtaccatgctgttttggttactgtagccttgtagtatagtttgaagtcaggtagcgtgatgcctccggctttgttcttttggcttaggattgacttggcgatgcgggctcttttttggttccatatgaactttaaagtagttttttccaattctgtgaagaaagtcattggtagctttatggggatggcattgaatctataaattacattgggaagtatggccattttcatgatattgattcttctgacccacgagcatggaatgttcttccatttttttcgtatcctcttttatttccttgagcagtgttttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagtttaaggagattttgggctgagatgatggggttttctagatatacaatcatgtcatctgcaaacagggacaatttgacttccttttttcctaattgaataccctttatttccttctccttactaactgccctggccagaacttccaacactatgttgaataggagtggtgagagagggcatccctgtcttgtgccagttttcaaagagaatgcttccagtttttgcccattcagtatgatattggctgtgggtttgtcatagatagctcttattattttgagatacgtcccatcaatacctaatttactgagagtttttagcatgaagcgttgttgaattttgtcaaaagccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctgaattcggtttgccagtattttattgaggatttttgcatcaatgttcatcaaggatattggtctaaaattcaattttttggttgtgtctctgcccagctttggtatcaggatgatgctggcctcataaaatgagttagggaggattccctctttttctatttattggaatagtttcagaaagaatggtaccagttcctccttgtacctctggtagaattcggctgtgaatccatctggtcctggacgttagactaaaaccataaaaaccctagaagaaaacctaggcattaccattcaggacataggcatgggcaaggacttcatgtctaaagcaccaaaagcaatggcaacaaaagccaaaattgacaaatgtgatctaattaaactaaagagcttctccacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgacaaaatgctcaccatcactggccattagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccgttactgggtgtatacccaaaggactctaaatcatgctgctataaagacacatgcacacgtatgtttattgaggcactattcacaatagcaaagagttggaaccaacccaaatgtccaacaatgatagactggattaagaaaatgtggcacatattcaccatggaatactatgcagccataagaaatgatgagttcatgtcctttgtagggacatggatgaaattggaaatcatcattctcagcaaactatcgcaaggacaaaaaaccaaacactgcatattctcactcgtagatgggaattgaacaatgagaacacatggacacaggaaggggaatatcacactctggggactgttgtggggtgggggatggggggagggatagctttaggagatatacctaatgctaaatgatgagttaatgggtgcagcacaccaacatggcacatgtatacatatgtaactaacctgcacattgtgcacatgtaccctaaaacttaaagtataataataacaaaataaaaaaaaaaataaaggtggtaggaaataaatagtatagtttcagggcttggaatggagtgtaaatattgtaatggacagttaaatctaaatgtagcagtaatttagtcaatacttacatagcactgaaatgtctatattgggtaggacaattagtaaaatcatattttaacaataataacaactatttagttgcctgaatatttcacttttcaatagctgatttcacaagaatgcagctctcaaagatatcgtgttgcttttaaccattttctccagatacatggtatcaatatattcaagaaaagaacagggttttatttttttcctgatgtctttgcaccaattttcccaatttcttttctaatagagtagcttgtatttaatatgcacaacaactgcaggtcattaattctctgagtctttcctaaatcaatcctctggatgtggactagaatcttaatacagttttagtagttgggaatctcatctaatttattacatggagagaggtatgacacaggaaaaatgcatattaactatgtagatgaatatgttttttttttctttccaagtatctgttttcttttcaaaatgatcatgaatagatagctacctaaggaaggttgtcacattagcttaatcaatatagaaattctatatatgaatatatatataagaatatagtattatgcatgcatgtattttacagctagttgtctattttctagaggcagctagacagtggtgaagagcaagtttcagctttgaggttttttttaactttttattgggaaataaaatagacaaccacgaaaaaaatgcattaaacattgatgtaaaaattaacagttggatactaaataaactgttgtacaactatcacatataactagaaatttaacaacagtaccagcacctcagaagccctccatgtgccccttctcaattaaaattcctccctctacccgatgaaaccactcttttaacttttgtcgtaatgaatttcttgctttcattatacttttaccacctaactatgcatccttaaacactatagtttaattttcatgggtttttgaagcttatgtaatgaaatcatcagttttattcttttctaattttttctttaacttaaaaatacttcataagatttattcgtgttagggccaggcgcggtggctcacgcctgtaatcccagcactttgggaggccgaggtgggcagatcacgaggtcaggagatcgagaccatcctggctaacatggtgaaaccccgtctctactaaaaatacaaaaaaaaattagccgggcttggtggcgggtgcctgtggtcccagctactcgggaggctgaggcaggagaatggcgtgaacccgggaggtggagctggcagtgagccaagatcgcaccactgcactccagcctgggtgacagagcgagactccgtctcaaaaaaacaaacaaacaaaaaagatttattcgtgttaatttatgtagctgtagtttgtgcattttcaatgctgtataacaattgtttgaagatgccacaatttttatatctgttttactgttgatggacatttgggttatttccaatttgggactattacaattgtgatgccattaacatttttgtgatagtcaataacaacgtacacttaaatttttgtcaagagggtaggacttcacattgggttcttaccaaaacaaggtaaaatagtaaaacagaataataattcttgtacgtgtctcctggtggtcttagtggtcatgtgcacatctgctattggatgttgccttagaggtagaattgttggcttagaagtatacaatttatattcctaccaacagattatgagtaaaccagtggctccccttccttaccaatgcatgagcattctggtgagtatattatactattgtagctttaactgtcatttgattgattgctaaggaaattgaacacatatttatgtttctcagaaatttggattttctcatttgtgaagcagctttgaagtctttgctcttttttgactgggttgtttgtcttctacaattgctatgtacattctgcatatagtgttttgttcatttacgtgttgcaaatattttttctttcattctttagcttatcccttcatcctcttcatgtttcattttcatttgacaaacagaagtccctaattttaatataattttccaacttcttctagtatggttattaccttttgagatgtgtttaagacatatttttcaaatgtgaaggttaaaagttccccaaaatactatctatgtaatcttctttaaactttgcagctaaatagctttaaaatttagctgtatgaggtattttcaaaaagttcatggaaaatgcatattatgaaaaaaactatgcatgtatttcaaaagtttttgcaccaaaataaactcagactaacttattaaaacatgcctaaacaggatctagtttgaggcactaaaaaggataaggtataagttataaaagagcatctatcagaaaaacatgaattgtgctaacattgaagcaagaacaaacatcaaatttataattaatggtgaaagaatggtgaaatcagtgatggtttacaaaaagtctatggaaaaaatgccccaaataagtcagcagttcacaaatggataactcgttttgtttttttgtttgtttgtttgttttttgtttttgatacggagcctggctctatcacccaggctggaatgcagtggcatgaactctgctcactgcaagctccacctcctgggttcatgccattctcctgtctcagcctcccgagcagatgggactacaggcacctgccaccacacctggctaatttttgtatttttaatagagatggggtttcaccttgttagccaggatggtctcgatctcctgacctcgtgatctgcccgccttggcctcccaaagtgctgggattacgggagtgagccaccgcgcccggccacaaatggataactcattttaagaagggatgagatgctgttgaagatgaagctcatagttccaggtcattcacatcaatttgtgaggataaactttattttgttcatgtcctaattgaagaggactgaagattaacagcagaaacaatagctgacatcacagacatctcaattggcttagcttacacattcctgactaaagaattaaaattgaatgtgcaaaacgtttgtgcccagatcagccacagaccagggcagagctttcagtgaaaattttaaagaagtgggatcaagaaccttaagctctttcttcaaataataataatggtagataaacatggctttaccagtactgtcctgaagacaaagcacaatcaaagtaacagctaccaataagtggtgtggtccagtcaaagcacaagcagaccagtcaagagcaaagattatggcaacagctttttgggatgctcaaggcattttgcttgttgactttctgaagacccagagaatgacaacatctgcttatcatgagagttctttgagaaagtcagtcaaaacttaatcagaaaagtgcccaggaaagtttcactggcaagtccttctgcaccatgaaatgtttctgttcattcctctcatcaaacaagggccattttctgagactttttgatggaaaaatcatttatcatccaccttatggtctatatttggctcttcctgattcctttttgtttcctatgctattgaagttgttgatttatttaagtaatgtgatcaatatcaaatttcatttttttcaaatggatgtctaattcttcccacatcatttattgaagaactgtctctttgctactgtgcttcaatgctacctgtgtcataaatcaagcatttaaaaatgcaacagtctatttctggactctgtgatcgttcagttgtctgttttccaatcctggtactaatatcacattttcttgattgctattgctttaaaataagccttgatgtcaagttaagaaactcctctcatgttcttttttcaaaggaatcgtggctattattgacctgttatttttatgtgcattttagaaccagctcgttaagttctactgcatccccaaataaaaagcaagctggtatttttaaaatagactttattttttagtgcaactttgtgtttacagcaaaattaagaaagtacagagacttccctgatactacgagctcgcacacatatataaccctccccattataaacactccccaccagagtggcacatttgttacaactggtaaacttacattgacataccattactaccccaaatatattgtttaattaagtttcactcttggtggttgtacattctatggatttggacaaatgtgtaatgacatgcatctatcattatagttttaaacagaatattttcactggcctaaaaatcatctgtgttccacgagttatccctccctcctccctcattcccagaaaccactaatctttttattatctctatagttttgcctttgccagaatgttatatatttggagtcatacaatatgtagactttttattggcttctttcatgtagtaatatacatttacattttcttcatgcctttttatggcttaggagctcatttctttttagtcatgaataatattctattgtctgatgtaccacagttgatttatccatttacctactgaagggcatcttggttgcttccaagttttggtaattatgaataaagctgctataaacatttctgtgcaggtttttgtgtgaacaaacctgtgagttaataccaaggcattcaatgaataatatggtaaatgtatgtataagccttggaaaaaattaccaaactgttttccaaagttgtactattttgcattcccaccagtaatgaataagagagctcgtgttgctctaaatccttgtcagcatttgatgttgtcagtgttttgaattttggtcattctaatagatgtgtagtggtatatcattgtttcaatttgagttttcctgatgagatatgatggggagaagagattctttgtcctcaatatctcttctttgatacagtgtcttttggtattttcaattagactgcattatatctcaagatgaatttggggagaattgtgacctttgtctccacaaaattatatgttgaagccctaaccatcattgtgactgtatttggagatggtgtctttgggaggttattaaaacaaactgtgatcataaaggtggtgccataaccagataggatttgtagccttataaggggagaaagagtgtatctctccatgcacatacatcaaggaaaagctgtgttagaacacaagaaagtggctgtctgtaggccaaaagaagaagtctcagaatgaaatctgccttacaggcatcttgattttgaattttccacctttaagagcaggaagaataaatttgtgttgtttaagctacccagtatataatattttgttatcaccatctgagatgacaaatagattttggtaccaggagtgaaatactgctacaacaaatacctaaaaaggtggaagtgactcaggagctgggtaatgggtagagactgaagaagttttgagatgtatgccaaaaaaatatggacattaagagtggtttcagttagacattagaaagaaaagaggagagctggagagaaaacttccatctttttagagactatatagccatgaaaagaatttgataaaaatatgaatgttaaaggccactcttgtgagatgtcaaatgaaaatgaggaacatagtattggaaatgacaaaaagtgagacttgttataaaatcgcaaagaacttggctgaagtgtgtttgtgttctagtgtttggtagaaggtagaactggcaaggattgaaatcaaatacttagcttaggaaatttctaggcaaagtgtcaaaagagcagctttgtttttcctgactgcttatagtaaaaagcaagaagagagagatgaattgaggaagacattattaaacaaaaaggaactggaacttgaagatttggaaattctcagccaattcatattgcaaatgttgatgataaagtatgtactgaggacaacaccaatggtgtgactggactatcacttgataaaatgtatgtaagattatactaacagaaatacagcaagtatgaactgaagggaacaaagataagatgaaatgaatgaaggccatcagactcattaaatttcacaggatgagtagatagaacaatttggctgcaaatgtattctatcctttaaaaagagagagaaatggccccaagataatttagagattttcagggccactaccttggttgcaacaagctagatagttgggggcagaactcgctagcagagccttggcagcaggttcttagggatgaggttttagaggcaggagcttagggatgagaccctaagaacaggatcaactggcagattttatagagccatcaaagccaagggtttctatttctagatattttttatttcagtcttttcacatatgatatttacatggtaaaattttatttactgtttattgctggaattagatataaattgtgtttgctgacttttgccagcaaccatgtcaaaactcttattaattctaataatttctttatattttatcattgcattttaatacacactttagtattatcttgccaatttctgctaaaaactacctgagattttgtaggattgtgttgagtagacaaatttgggtggggggagtgggtattacatttttaacaataataaatatcttgatctgttagtataagttgcttttctatttacttagatctttaatttctttaaataatgtttccatttatggtgagacatcttcacttctttggattaatttattcctaagtattttattcttttgatgctgtcttaaattgaattatttacatttttagtttattttattgtatttttaacttttattttaaattcggattacagatgcaggtttgttatctgggtaaacttgtgtcatgggggtttgttatacagattatttcatcacccaggtttttagcctagtaccctttagtcaatttttctgatcctctcccttctcccaccctgcaccctccaaaaacaaatatcatttaacctagcaatcccattactgggtaggtacccaaaggaatataaatcattctatttttttattttttgtagaaacagggtctcattatattgcccagactggtcttgaactcctggcctcaagtgacctgctggcctcaatctcccaaagtgttgggattacaggcttgagccaccaggctcagcctgtatatagattatataattgatttttgtgtattgatagttacatcctgcaacattgttgagcttttttattagttataataactttcattttatttcttaggatattctgtatatataaaatcatgttaactacacataggataatttacttctttcttttgtatctgaatgtcttttattttattttcttgcctaattgtcctggttagattgtttagtacaatgttgaatagaagtcgtgaacctgggccgggcacgggggctcacacctgtaatcccagcactttgggaggccaaagtgagtgattgcttgaggccaggagttagagaccagcctggccaaaatagtgaaaacccatctccactaaaaatatatacaaaaaaattattccagtgtggtggtgcgtgcctgtagtcccagctactagggaggctgaggcatgagaatcgctcaaacctgggaggtggaggttgcagttagcggagatcgcaccacttcactccagcctgggcgacagagtgagttctatctcaaaaaaaaaaaaaaagaaaaattagtgaacctggacatacattcttgtattgttcctcatcttatcaggataatgtatagtccttcaccatttttaacgtgatgttagtttacatttttcacagacaccttttattagtttgagtaagttcactagttttccgtgttcattaactgtcataaaaagaagtttgtatttttctaatggtttttctgtagctattgagatgaccatgaggttattgttctttaacctattaatataatacattatattaattgattttcagctgttgaaccaaccttgcatcctcaggataaattcccacttggtcatattatataatcctatttatgtgttgctggctttgttgtcctagtattttgttaggttctctatttgtatgaaaaagagatatttatctgtagctttcttatggtgcttttgtgttgtttggtgtcaaggcctcatagaaggaggttggatatatttcctcattttctatgttttgaaaatttgcgagagagaggtgttatgcttcaaattttctctagaatttactaatgaagccatttgggcatttatttgtgggaagttttaagatttttaatgtattccctatgatttgtttcaatccattcagatattttaatttttcttgaatcagtcttggtagtttgtttctagaaattattccctttcatataagttatcctaattttgacttacagttttttatagtattcactttcatatttaaaaaaaaatatttctgtaaggtcagtagtaattttagcaatgtaagtcttctttattttttttcttggtcggtgtagatagtgtttttaatttattcatcttttcagagaaccaaattagattttcttgactttctctattgtttttcttttccattaatttctgttctaacttttattattcccttctttatacttgctttgtattaaattgtttctctttttcctgtctcttagcaagaaaaataacgctatttagttgggatctttctcttttttaaatatagaatttacagctatatatttatcttaaagcgctgcttttgctgcatctcatagaatttagtatgttgtgtctttatttgcatttatcttaaactattttctaacttcctatctgtgagcattggttacttagaagtattcattattacttttaaatattcctgcatattcttaaatgtccaaaatttccttcttattgatttccaatttagttttattatggctggaaaacatgtatgatctcaattttataagaattttttcaggcttgttttatgacagcacatatgttctattctgcagaatgttccatgtgcacttgagaggaaagtgcattttgctttaatggcttcggtgttcagtacgtatctgctatgtctagttggcttatagtgttgttcaaacatgtattttcaaattcttatatttccttgctgatcttctgtctagttgttctacttattattggaaattgagtattaaagtttccaactactattgttgaagtgtctctctcttttattttgtcagtttttttaaatataattttggcttctgatattagtgcatatatgtttgtaattgttacaccttcctgatgtattgagtcttttatcactataaactattgctttgtatctctggtaatatttattttttgttttaaagatgatttcatctgaagttaatgtaggcactctagctctctcagggttgctatttgtattgtatgacttttgaaatatttgtactcaagctagttgtatctttgaatctaaagcatatctcccttccaaagtgtataattgttttgatggttcttatctagtctaatgatctttcactcttgattggattattcaatccattcacatttaatgttattattgatactgttggatttgcatctgctagttttcttttggtattgtatgtctcacgtctctttttgtttctctgttcccccatactattttttcatttaataaacatttcctggtattaattttaactatatcttttagttacttgcttagtggatgcactagggtttataatatataccttaccttatgagaattagcatcagacttatactatcttaattccagtgagctggatgagttttaatcttataaagctctattccttctttcttctttttgtgctactattgaatattttatcatcaattatgatgttttctcttaagcttttttaggaggcaagatggacaaacatttcaataaatcactatttcttaaaaatctggaatgaatattaaattttaccagatgctttttctacatttattgaaataattatataatttattctttattcagttaatgtgatgaattatcttgcttgattattttttctgtatcaactttgcatttctggaataagtacatattgatcctgataatattattattttaaaatattgttggcattagtcaattaatattttactgagaaatttttatctatatttgtgagtttggctagatgattcttgtcatattttagtactgagtttactacattgtcaagttgaagttaattaattttttataatttcttaaagttttttttcttaagtttgaaagaaatcactactaggaatatatttattccatctaagttttcaaatatgaatttcaaaattttggaatttgaaatttcttctcaataaactatattatcgttaggcagacatgagtatgaatctggtttcacccacctatcagctatgagaacttagaaaattcagttgatttctctgatcttcagttttctaatgattaacacatggataattaatagtacctattgcatttctgatagcaaattttctatatggactactcctgatggtacaaattatttaaaattcaagataaaatgtataaataattctttagctggaagagaaagcagaaaaatcctcaaacagtataaaacatcagtacagagctaactttggccttgaggcatctgtgaatctccagtagcttacaaattaggcttacaaaacctaaagccaagtaggataagactccacaaaaatccagattccctaaaatgcattactcttgatagaatcttgggaaaaatcttgccattcagtaggaatgtgtggagatgtatagcgttcttagtctagatcctgagtaaagtagaaaaaaactagtgctctccaagaagtcttagctacaagtcagaagtcaatgagttgggactagaattcacaagatttttgtgccttagaaaaaagaaaacaactgaagtcaatttctgtttaaagttgttctgagttggcagtgtacccaggtatctggaaagaacaaacacaaatcttctttataggaagcactttcagtctgacctgaatgtgtttacagagaaagtttaaaaggatataaatatatgcacacagcaggaaacatctaaaaaaataagccgctataagcaaaagtcagcagacgtaatgaactacagactcagtctgtaggttctgcatatactaggtcctagaatcatccaatactgaattacatatctatgtatctatatctatatataaacatgtgtgtgtatatatatatatttatatatagctgtagatagaattaagactttatgaagaatagagaactactgtagtataattttggtaggctttaggcacttaggccttcctgcataaataaataaataagataaataaatgtatacacacacatataatttatattttatgactgtgctggtataagcacaaatatattaatattacatatcaaaacattttcttcaatccaaaggttattttatttcttctagttttataataattaaaacattttaaggaaatgtgccaggagccctaggcattgtacctaatggataatttggcccttggaggaagcaataagatggtattgacagccagatttagaaagtaaccaaatagaatttttagactttaaaagatttaattataaaaattataattttaatagtggcctaataacaaattcgacacagctgaagaatgaattgttataataaactgagagattttaaaacacgttttctcatttctaatctaataatatttttactacattctgatttctatttactaagcagtttgtggtcattggccttattttgtgcctagaactgtgttatgtgggattagggtataaaacagaaaagctattcacatatgtaattcctgtgatttgaaaattcccaaaagttttgtgcataagaaatctggagcaacgatctttaaaatagactccacatatctatcctttaaaataaaatagttcatgctcaaaaaaatccagcactatttggaatatagggtttaaattttgatacatttttttcaattttgttttgagctttattttctaaaatgatctaaagaatcatttcctttgacttcttcccactatgcagggaagtaagactttgaagaagtatatggcttattcttgttctttaacattcaaatgtggctcttatccccactatatctaaacactttttatttttatatgtacacctcattaagtagatagtaagtactcttaaatgaagcaagacaccagtgcagtctctttattccttcacgtgactaatatggtcttgccacatggtatatgtgaaatcaatacacttctcaatgcttcttgtttatagaaaatcctcactttgattttattgtttgattcttttatgttctcttattttttttcacttcaatttgtcttttataagtgtcttgagtattcttacggtatcaagttgacaagtactagcattcaagaaattatgcaatctgcttttgtatgactttgtttgtagagccctaatgaatccatttactcatctattctattcttccatagaaatttattaaggatccactctttgtcagtcatggtgcttaacactaagcataaaaaattttaaaagacagaagttctctgtcctcccagatcatagatgaacaataaacaggtaacaaatggaaggattgattcatcattgcaaggttcataagctgggtatcatcatggagaatagaaaaatacaggtatctactttggatacagttttcagaagggggctctctggagcagtgacattaatttggggcaaaggatgagaagaaaccagccaagacaaagcttggcagaaagcaatcccggcagagggaacaattatgccaaaagcactatgtgggaagtaagtttagtggccaaggaactgagagaaagataaatcatactgagctttggggccataggaggtagactattacagtgagaagactctgaggttttgttaagcagatgagtgagtgagattaatgtttacatcagttacacttgctgctctgtagagaatgaataggagaggcagagagggagagaacttaggaggctgagagagcagcctcagttagaggttgtgaaggctttgacgaggctccaggggaaatatttttatgtttctgcacattcagggctttttgagtaaattttactggaacttgagacatggccttaaagagtaagatttggaagttaaattgcaattgattgaataatgatatgccgttcagagagatagtcctccactgcacaattattttatcctcatcttagatacatacatttgcactcacacacacacacacacatgcatatacatttacatttcaaagagtaagaaccaaggagacttcaaaagttgaatttgtttatttaaggagtaaacattttctctccatttctcaggggaggagtgaggacaactttccctctactatataaccactgtgattcatattttcatgattccacatctactatacagatcctgccttgtacgatgacatctagctctccaagaatcagagcaaagaatattcagtgaagtttgctatgaataataactaacctgtatgtgcctcaggaaacatcatgtttacattcataataatattactaaatatagatgttaaaaacttagcactgtgagaagggaggcaagatggcaaattaggcatagccaagaagagcttctcccaccaagagaaacaagaccatcaagtagactagcatattcccaacagatctttgaaaagaaggcattgagagtggatagaaagaggatacagacctggggctgaagcaggaggaagctgaaaaccctgcaaggggttgctgagcaccaggactcattttggccccaagcagctcccagggaaaaggtgagtttgaataggcatagagtggccccctctcatcacagacctccagaatcttagctgcagcagactacatgattctcatggatatttgagctggcagggaactgcccagagagttgatggagacagaattgtagcctgtgtagagcccaaagagtttgacatgggaacggctgcagtggatcataaccttaggatcccatcctccaaggcttgccatgctcctctaggtggctttagcctgtgttggctgctaaacttggacagaacagtgctatcttgtccatgggatgtggccaatatgatatgagtacccctctgtcttcagatctattatggggtccctggctgggtgtatctgcttgcagcgcagcctcagctgccaagccaagatgcttaccggcagccatcaccatagctcttttcatggcagacctctcctaacagttggatagcttctgtaagtgggcatccaccagctagtacccatgcacagccttcccccatcggcgtgcactcgcctgcagcctcctcctgctgcttttcaaatggatacatgcacatgggtcctgccatcacctaccacccccgcactgaagcacttttgccagcatcccccatcggagtgttgttgcaagtggactgggaacaccttgggtcctccagtgcaggaagtgcataacctcgaggggccagagaaaaaagccgtaagactggtcccagtccttcagggttagagcacaaatcctaggattgctgagctgagccttgactccgtgaaatcatccagaaataaagccgatcatctaaattcgacttataccacagccaaaagcaaaaagccccatccaaagtggcaattttaaagattaaggacacttcagcccaaatagatgaggaagaaccaacataagaattctggaaagtctaaaatccagagaacctccaaacaactatagtagctcccagcaatggttcttccatagactaaaatggctgaaattacagacataggattcagaatctggatgacaatgtagattaatgagattcaggagagaaatgaaacccaatccaaggaatctagggaatccagtgaaatgacacaagcaacacaagagctgaacgatgaaatagccattttaagaaagaactgaattgatcttctagagctgaaaaactcactacagtaattgtacaatgcaattggaagtattaacagaatagaccaagctgaggaaagcttctcagagctcaaagaccacttcttcaaatcaactcaaacacaaacaaattaaaaaaataattttaaaaaatgaacaaaacctctgggaaatatgggattatgtaaagagaccaaatctatgattcattggcatcctagaaagagaaggagaggcaagcaacttgtaaaacatatctgaggatattgtccacaaaaattttcccaacctcacgtgcaaatctagaaaattcagctaaattaaatgagatgctatacaatatgaccatccacaagacacgtagtcatcgtattctccaaggtcaatgcaaaataaaagatattaaaggcagctagagagaaggggcagatcacgtacaaagggaaccctatcaagctaacagcagatattttagcagaaactttagaaactagaagagtaatgcctatattcagcatccttaaagataagaaatcccaaacaagaatttttttattcagccaaactaagcttcataagcaaaggagaaataaaattctttttgaataagcacatgcttacggaatttattaccaccacctgcccttacaagaagcccttaagggagtgctatacatggaaatgaaagaccattacttgtcaccacaaaaagaagtatacagcccactagactataaagctactgtacaataaagtctacacaacaaccagctagcaacagaaagacaggatcaaatcctcacatatcaacattaaccttaaacccaaatgggctaactgctccacttaaagggcaaagagtggcaaacaggataataaaacaagacccaactgtatgctatcttcaagagacccatctcccatgcaatgacacccataggctccaaataaagaaatggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggtgggcgcctgtagtcccagctgcacgggaggctgaggcaggagaatggcgtgaacccgggaggcggagcttgcagtgagccgagatcccgccactgcaccccagcctgggcgacagaacgagactccgtctcaaaaaaaaaaataaaaaataaaaagaaatggagaaatatctatcaagaaaatggaaaacaaaaagagcagaggttgctattcttatttcagacaaaacagactttaagccaaaaatgatcaaaaaagacaaagaagagcattacataatgataaagggtttaatttgacaagaagttttaactattctaaatatttgggtacccagctctggagtactcagatttataaaacaagttcttgaagacttagttaactacactgtaacagtaggagacttcaacactccactgacagtgttagatatcatcaggcataaaatgaataaagacatttaagacctcaatgcaacacttcacaacatggaactaacagacatctacagaacaatccatccaacagtaacataatatacattctcatctgcatatggcacataatctaaaatcaatcatatgcttggctataaaggaattatctaaaaattcaaaaaatggaaatcatacaaagacactattggatcagagtgcaataaaaatagaaatcaataccaagaagatctctcaaaaccatataattacatggaaattaaacagcctgctcctgaatgactttggggaaagaatgaaaataaagcaggaattaagaaattatttgaaactaatgaaaacaaagatatagcataccagaatttctgggacacagttaaagcagtgttaagaagaaagtttatagcattaaatgcctacatcaaaatgtcagaaatatctcaaattaacagttctaacatcatatgtagaggaactagaaaaacaagagcaaaccaaccccaagcctagcagaagaaataaccaaaatcagagctgaattgaatgaaacttacacatgaatccataaaaaagataaaaaaaaagttgatgttgtgaaagcataaataagaaagacaattagctagactaataaagaaaaaagagagaaaattcaaataaatgcaatcagacatgacaaaggtgacattaccactaaccccacagaaatacagaaaatcctcagaggtttttatgaacaccgctattcacataaactacaaaacctagaagaaatggataaattcctggaaacatataacatgctaagattgaaccaagaagaaacagaatacctgaacagaccaagaatgagctccaaaatggaatcactaataaaaaatctaaccagaaaaagccctggatcagatggattcacagtcaaattcttccagatgtatacagaagatctcataccaaatctatggaaactattcaaaaaatcaaagaggaggtattactctgtaactcattctatgaggccagcattgttttggtaccaaaacctgacacagacacaagaacaacagcaaaagcttcaggccaatattcctaatgcatatagaagcaaaaatcctcaacaaaatacaagaaaatcaactggagcagcacatcaaaaagctagtccaccacggtcaagtaggctttattcctaggatacaggattggttcaacatatgcaaataaataaacgtgattcatcacataaagagaacttaaaaaccacatgattatctcaataaatgctgaaaaggcttttgattaacattccacatcccttcatgataaaaaccttcaacaaactgggccttgaaggaatacacctcaaaataataaaagtcatctatgacacccacagctaaaaccatactgagtgggcaaaagttggaagcattcccctggagaaccagagcaagacaagaatgcccacgctgaccatttctattaaacatagtactggaagtcccagccagaataatcaggcaagagaaagaagtaaaagtcatccgaataggaagagacgaagtcaaaccacctgtctttgcagacaatatgattctatacttactaatttccatagtctctgcccaaatgttcctagaactgataaacaacttcagcaaagtttcacaatacaaaatcaatacatgcaaatcaggagcatttctatacaccaataatgtccaagctgacagccaaattaagaacccaatcccgttcacagtcctcaccaaaagaataaaatatgtaggaacacagctaaccaaggaagggaaaaatctctacaagaagagttacaaaacagtcctgaaagaattcagagacgacataaacaaatggaaaaacattccatgctcatggataggagtcaatatagttaaaattgtcatacttccaacagcaatttacagattcaatgctattcctatcaaactaccaatgtcatttttgacaaaattagaaaaaagctattctaaaactgaaaccaaaaaaggagcctgaatagccaaagcaatcctcagcacaaaaaaaaagctggaggcatcacctgacttcaaactatactacaaggctacagtaagcaaaacagcatggtatttgtgtaaaaacagacacatagaccaatagaacaggtcagagaaccctaaataaatctacacacctgcaaccatcagatctttcacaaagctgacaaaaacaagcaatggggaaaggactccctattaaataaacggtgctggtataactggctagccacatgcagaagactgaaactgggcctcttcctttccccacatacaaaaatcaactcaagatggattaaagacttaaacataaaacctaaaagtataaaaattcctaggagaaaacctaggaaatactattccagacataggccttggtaaagatttcatgacaaagaccccaaagcaatggcaacaaaaacaaaaattgacaaatggaatctaattaaactaaagagcttctgcacagcaaaagaaactatcaacagcataaacaatctacagaatgggagaaaatattctcaaactatgcatccaaaaaggtctaatatcaagtctatagagaacttaaacaaatcaacaagcaaaaaccaaacaatctcattaaagaagggcaaaggacatgaatagacacttcccaaaagacgacatgcatgtggccaacaagcataggaaaaaatgttcaatatcactcattagagaaatgcaaatcaaaacagcacaatgaaataccatcacacaccagtcagattggttattattgaaaagtcaaaaaataacatgtttgtgagggtgcagagaaaaggaaattgttatacattgctggtggggatataagttagtttaaccaccatggaaagcagtttggatattctcatagaaatgaaaacaatctaccatttgacccagcaatctcattactgggtacttacccaaaggaatgtacatggttctgcattaaagacatttgcatgcatatatccattgcagcacctttcacagtagcagggacatggaatcaaccttgatgcccaccactgttaaacagcataaagaaaatgcagcatacatacaccatggaatactacagagccatcgaatgaatgaagtcatgtcctctgcagcaatgtggatgtccctggaggtcattatcttaagcaaattaatgcaggaatagaaaaccaaatactgcatgttctcacttatatgtggatgctaaacactgagtacacatgtacacaaagaggggatcaatagtcactgggaattacttaagggtgcagggtgggaggagggtgaggaccgtaaaactacctatcaagtagtatggtcactacctgggtgatgaaatcatttgtacaccaaaccttactgacacacaacttacctatgtagcaaacgtgcacacgtacccccgaacctaaaaaaaagaaagagttggaagaaagaaaaaaaacactgtcattggagatgacaaaaagttgaaaaaattaaaatatatttgtaaagagattccaaaaaaaaaaaaaaaaaagacctttctgatggattaaatgagggttgggggacaaaagaaaggagtcaatgatcactccaagttttattgagatgaggaaagactgagggaggaggaggttgtggataaaacaataaaattctgttttggtcaacttaagtgtaaaatatatatgaggcataacatcaagtttttaattatgcaattggatgtgcatatctctggctagaaaaaaaatcaacttgaagtcacactttcactcttttgtctcactgaaggctataattcacaagcatgttatgcttcctaaacgacagagctcagtgactactccactagtttaattgactgaagaggactgaaagaagataagaattccagaactagctcacaaactagtcttttgacattgaaggtgttagactggaaaacagtgaatatcttaatcaactctgtaattctgtgattctaattattttttaaatttttttcattaatgaatccatgttggttatataacgcaagttgcaactgtatccaaattgttcctgtaaagttaaactcaatctagtagactttctttctaagaagaaataatcagccaaagtttgcagacatcaacagttctggttaaaaaattgcttctaagaaaacacctcaatatttcactggtcttcaataactattacaatcaactattattctgatagttgactggcataactgagtagttctcatttgatttattgtgtagttgcattctgatgatgttttgagctgaaggcatctgaagatatccccagtcacattttcagtgcctgggatagaatgattagaagagacaggtgccagttggtcacctctccctccacctggccttttcatatagctagcatggatttgctaacagcctggggatctccagacagaggcttctttcatagaagggagaagctgcagtgactcctcttatttagtcacataagtcacacagcattaattttataatattttactgatcttaacagtctttggcccctccacattcagggagttttgagaaataaactccatctctgagtggcagaatggctagcttcgggaggggtggagaggattgacagtggttatcttggaaacaatctagcacatccctctgatcatcatctggtttgaatgaaaaacaatagttttttcatatctcagcctccagtcaggggtgctgaccagatggaataattagtgggctgctaaccagaacacatgttctaaggaagaatgtataaggctgattctctcatccagctgtgactcatacctctaaaaagcactccgaggctggcatacctgacagcaccctactttggtcatgtcctctcccatctccatacgtgctagcaccttcaatgtcaaaagactgattagtgaggcagttctggaattctaatctttcagacctcttcagtttaattaactagtggaggagtcactgaacaagtaggaagcatactatcttgtgaataactatagcctgtggtgagataaaagagtgaaagtgtggtttcaaattcccttaagactataacacattgtaatttttttttctagccagagatgtgcacatccaattgcataaatgaaaacttactgttatgcctcataaacattttacaagaaatggaaaccctaccatatttgcaatctgacctcccttgtggctaatcatggtttttccacttttatatttttgagaattctagagcacagaatctccccagtctactcaagaacagtagtccttaaactgtggtttgggtacacatggcaatacaggaaccgatggtgatacaggtaaccatggtgacacagaaaatcttctcatcagggtaattgcaggaagagttttaaaggaatccatttccagatccttaacatccatatgtgctctttgtcaaatttatctgcttgagaatgaaccagcattaatgaattctttcttttaatttaccaaaaataaataaatgataaactaacaaataaataaagttcttcacccacgctaaatcttacagtgatgttgtaaaatccaccagggcttcgaacaaagaagaaatggaaatgttggcttaaggaacattttagtatttaatttcagaaacataaatatgcaggatttcctgacttgatatgtattttggtgggggacaaagcttgctgtaaggtattttggcctatttgtcggtgctgtaaactcacatagcttaagcagcataagttagtgattctttgaaatgtagttggaatgctttaaagaaccatcatacatttcaaagtacattgtataaaacacatgggtaaaattttacataatgcatttcaaatattgtgtgtttaactcaatacacaggtgaaatcgtttttcaaattacattataaaatgttcatcccagttatatacattcatattatttcatcttgtaatagtttctgggtatcataaataagttatattaatttagactcataatgaaaatatttagatgtcaaattaaaatgtgtagagaatatgtagttttatcaaaattctcttaagggttgtataaactaaatgaaatgctacttatgctctatttcttatcactgtattcatctggctttattgaattacttgttattagtttgacttcacctttggaccgtaggtcacattactgcaaagataatatctgtctattatggctgtatccaagatacctaccacaaagcctcacattactagacattcaatgagtgaattgaatataagcatgaatgaatgagtgagtgcatgagcaaagcagcaggtatataaaacacagcagccttttcccttgtttaaacttttattgattattttctgagccacctactctactactttttgaggtttaatgcctttatcataatattatgtcatctattttgcaaagtgctataatcatattagctgaagagtgtatatgttaaatgctatttgactatttgactttttaaagagcagttatattgagatataatttacataccataaagttagcccttttaattttcagtgtaaaatttaatgtaaaattcagtggtttatagaatactctcagaattgttcagtgatcattactatctaattttagaacactttcattacctgaaaaagaaaccttatagcagcagtcacctccctctcagtttatgcaaccactaatctctgtttcatagctttgcctattctagacatcttattttatttacttatttttgagacagtttcactctgtcactcaggctggagtccaatggcatgaactcagctcactgcaacctccgctttctgggttcaaacgattctcctgcctcagcctcctgagtagctgggattacaggcatgcgtagccatgcttgttaatttttccatttttagtagagatggggtttcaccatgttggccagactgacctagaactcttgacctcaagtgatccacccgcctcggtctcccaaagtgttgggattacaggtgtgagctacagtgcccagcctagacattttatataagtggtactacacagtatctgatcttttgtgactggctctttcacttagaataatactttcaatattttttttcatgttgtaccgtgaatcaacaatttgttttttaaaactgatgaacaatattatattttatggatttatcacgttttgttgatccattaatcagttgatggacatttgggttgcttctacgttttggctactatggctaatgttgctctgagcatttatgtacaagttttagagggacatatgtttctatttttcttaggtgtatacctaggagcagaattattggtttacatggtaactctgtttaacaatatgaggaaccaccaactctattccaaattggcatcattcatgagtatatttttatggacttaatgaccatttataacacctttttgggggaattgttaattcaaatcctttgctcccaaaattggactgtctttttattgttaaattataagagttctttgtacattttggatacaagtctgtcatcagatatatgatttataattttttttcccattctgtattttttttcttttttcttttttttttttagacagagtgtcactctgtcacccaggctggagtgcagtggcgcaatctgagctcactgcaaactccacctcccaggttcaagcgattctcatgcctcagcctccccagtagctgggattacacgtgtgcgccatcacgaccagctcatttttgtatttttagtagaggtagggtttcaccatgttggccaggctggtctctatctcctgcctcaacctcccaaagtgctgggattacaggcgtgagccaccacgcttggccttttttccttttttttttttttttttttttttttgacagagtctcactctgtcgcccaggctagagtgcaatggcgtgatctcagctcaatgcaagctctgccacctgggttcacgccattctcctgcctcagcctcctgagtagctaggactacaggcgcccgccaccacgcctggctaattttttgtatttttagtagagatggggtttcactgtggtctcgatctcctgacctcatgatccgcccgccttggcctcccaaagtgctgggattacaggcgtgagccaccgcacctggcctttttcactttcttgatggtgtactcaatagcaaaattttagacaatttggatgcaatacagtttacctatgttttcaattatccctcatgtttttggtgtcatatctaagaatattatttaatttgttttttatttttatagagacagggtcttgttatatcgccctggttggtcttgaactccttgactcaagcagtcctcctcccttaggctctcaaaatgctggggttacaggtgtgagccactgggcccagcttgattcttaataattattgttgaaaataaatataagcattgccatgctgattaacttgctttctgtggctgccctcacttacaatgcaaattttacagactcctctagacatttagctggaactgccatgtgttttccctaaaaccagctcataatagagctgggctcaccataaatccatttcctactattcggttgagatctgcaggcacttttactttgtaaaatggtcttgctcacgcctgtaatcctagcactttgggaggccaaaggcaggtggattgcctgagctgaggagtttgagaccaggctgggcaacatggcgaaaccccatctctctgaaaaacacaaaaattagtcaggcatggtggtgtgtgccgttaatcccagctactctggaagctgaggcatgagaatcgcttgaacctgggaggcagagtttgcagtgagctgagattgcacactgcactccagcctgggcaacagagtgagaatctgtctcaaaaaaaaaaaagaaagaggaaaaagaaggaaaaaaaagcccttaggggaacataagtactgagagtcttagcaagcaaagaatacatgttttgagatgaaattgagggaaaatagagagtatagtgtatttcggaaaaggaaataagactggtttgttggaggacacaccagcatgatctctttcttattatccttgggatagatttcccaaatgatattctagcccctcagggcaacaacacaaaacacagcaaaaaaaagacaaaaaaacaaaaaacaaaaacaaaaacaaaaaaactcacagcatttacaggagtaaaactaattgtaatcatatgattcaaaagagcagtgcttttatactttcatatgtatacagattacctgttaaaaacataggttggctgggcacggtggctcacgccagtaatcccagcactttgggaggccgaggggggctaatcacgaggtcaggagtttgagaccagcctggctaacacggtgaaaccccgtctctactaaaaatacaaaaaattatctgggcatagtggcgggtgcctgtagtgccagctactcggcaggctgaggcagaagaatcacttcaacctaggaggcagaggctgcagtgagccgagatcatgccactgcactccagcctgggcaacagagcaagactctgtctcaaaaaaaaaaaaaaaaaaaaaatcagtcaggtagtgattaagcaggtatggaatggggtcttcaaaagcctacatttttaacaagctgcaggtaatgatgatgctgttggtcaggaaccaaactttaaactttaaataccaaagttgtggaaggcagaagggagcaaagagttcattccctccttcagaaggggagaaacattcactttgcaatcaggctgtgtttatcgagatgactgacattttttgcatgtgttcagacttaaaggtcagatctgtttccttctcagcagctgcgtgggaattgcttatctcgcactttctgtatggggtttgattacctaagtgaaccaagaagtttcacaatattttggagaaaaacacttctagtagcatccaacatgcaacattttaaaccagctatgaaatggcaggcttacaaagtcaacttggaatcacatctctggtccaggcaaagggaatgaaaacccagagactatctccccgagagccctgtagctgtgtgtgaatgtgtacgtgcagggatatggactgtagaccctgttacaaatactaaatatctgtttggaagaaggctgtcctcacatgtgccgctaaaatcatccacaggctagtcttaggccaaacggtaaaaggaaagaagcctatccttggcaattattcaagcagacagtctgacaagctttcctgagtgtctagtacatactaagcacggtattcatgtcccaggtacagagattaacaagtctctgatccccaatgcacatggcttgatgggaagtctggcattgaaatagacaattgcaacattgtaacgtgtgtggtataatagagatatacacagactggagagaggtccaattcagcctctggaggcagaaagctcaggaataacttctcagatgtgatgcttgaatttgttgcccattttttttatttttcctcccaagtgcctttataccatttaagggactcttctgcaaagaagacggaatttaaggtaacttcttcacttggtgttattgatggtggcatatgatacttggtccagataacgggcctgaatttccaaaggtattcaccactgcgagctattcttaaaatctaagaatgaattgacaataatagagtttcacctactaggaagacagatcatttgggggctagagtgcttatgttccagtccttaaaagtcacatcgctggaatgactcctgatgtttgtcagaagctggatcagatcacaaaagcccttccttggagcaagaggcctccgccaggactgagctcatttacttgacctgaccctgaatttccgtagtggagacaagcctcaggaaaatactaactgcctgctgtgttcccatactacaaaagagtgatctgtagaagtgacaggtactttccccctctgggagagaagggtccatgtgttctcctgcctggaccctctagcaagctacttaatatggaatcacacccctggaggagataggcaaacccttgaacagccaggtcaaatctaaaaggcaactgcctctagctgcagaggcaggtggcagcttaaagtggcaccaagtcataaaatgatttcccttttgagcttgggggaagatacaattttttttttttttttttgagacagagtctcgctatgtcccccaggctggagagcagtggtgcgatctcggctctctgcaagctctgcctcccaggttcacgccattcttctgcctcagcctcccgagtagctgggactactcgggcccccaccacgcccagctaattttttgtatttttagtagagatggggtttcactgtgttagccagaatggtctcgagctcctgacctcatgatccacccacctcagcctccaaaagtgctgggattacaggcgtgagccaccgcacctggccaggggaagatacatttttaagcagcattccaggctaatatgggagtacatggatgcaacactgtatctcatgctggattagcagccctggaaaccagagctgtctcttaatcaagactaggtattgtgaacccaggtaatctgaggcaggtctcagttaatttagaaaggtttttttttttgccaaggttgaggacatgtccatgacatctgcccaaggttgtcagggcatagcttggtcttacacattttagagagacatgagacatcaatcaatatatgtaagaagtacattaattcatccagaaaggcagagacaactcaaagcaagcctccctccccaccctgagggacttctatgtcacaggtggatgagacacaaatggttgcattcctttgtgtttctcataagtctttccaaagagggcaatcggaatatgcatccatctctgtgagcagcaggatgactttgaatagaatgggaggcagatttgccctgagaagttcccagcttgaaagggcccaagacattttcctttcacagtatcttagtccattttgtgttgcaataaaggagtatctgaagttgggtaatttataaagaaaagaggtttatttggctaatggttctgcaggctgtacaagacgcatgacactggcatccatatgctcagctgctggtgagggcttcaggctgcttcaacttgtggcagaaggcaaaggggagccagtatgtgcagagatcacaaggcaagtagggggagtagggggaggttctaggctctttttatcaaccaactcttgtgggaactaataagagtgagatttcaccaaccctccccaccagggaaggcattaaggtattcacataggatccacctccatgacccaaacacctcccatgaggccccacctccaatctccaacttatgaggtttggggagacaaacatccaaactacagcattttgcccctggccttccaaatgtccttctcactttgcaagataaaatcatccctctccaataggcctccaaagtcttaacttgttccagcatcaactcaaaagctcacgttccaaagtctcacctgagactcaagacaagttccttagagctgtgagctgtaaaatcaaaaataagttatttgctttcaaaatacaattattgtacaggcattaggtaaagattctcattccaagagggagagatgagccaaaagaaagggataacaggccccacacaagtctgaaaatcagtagggctgacattaaatcttgaatctccagaataatctacattgactacatgtcccacatcctgacacactggaagaagaggtgggctcccaaggcttagggcagccctgaccccatggctttgctgggtgcaatccccctggctggctgctgtcatgggttggagtagaatgcctgtggcttttccagcctgagggtacacggtgccagtagctctactattctggggtctggaaggtgatggttctcttcctgcagctatactagatgtggtcctagtacaggctctcagtggtggctatgcttctgcagcaggcttttgcctgggcaccacacattcccatacatcttctgaaatctatgtggaagcctccaagctttcaccactcttgcattctggacatctacagacatagcacgaggtgtatgcttccaaggcttcctgcttacacaccccagagtggcagcctaagccatgcctggggctctttgagctacatctggagctggaacaacaggagctatcgggggaaccagcccccaatatttcaacgtaggttcttttctattttccctaagtgtcagctggtctgagaaataaagagaaagagtacaaaagagagaaattttacagctgggcctccaggggtaacatcacctattggtaggttctgtgatgccccctgagccacaaaaccagcaagtttttattagggatttcaaaaggggaggtaggtacaaacagggagtaagtcacaaagatcccatgcttgaacggacaatacaagatcacaagggcagagaggcagagcaagatcacaaggccagggcgaaattagaattactgatgaggttccacgtcctgctgcgcacgcattatcattgataaacatcttaacaggaaacggggttcaagagcagatgaccagcctgactagaattcgccaggctggaatttcctaatcctagcaagcctgagggcattgcagcagaccagggcttatttcatcccttgtcttcaaccgcataagacagacactcccagagtgtccatttagaggcctccccctgggaatgcattctttcctagggttattccttactgggaaaagaattcagagatatttctcctatttggtttctgcaagaagagaaatgtgactctgttctgcctggccccataggcagtcagaccttatggttatctcccttgttccctgaaaatcgctgttatcctgttcttttttaggatgcccagatttcatattgttcacacatgttttacaaacaatttgtgcagttaacgcaatcatcacagggtcctgaggcgacatacatcttcagcttacgaagatgatgggattaagagattaaagtaaagacagccataggaaattataagagtattgattgaggaagtgataaatgtccatgaaatcttcacaatttatgttcagagactgcagtaacgacaggcataagaaattataaaaatattaatttggggaactaataaatgtccatgaaatcttcacaatttatgttcttctgccacggcttcagccagtccctccgttcagggtccctgacttcctgcagcagggagcagtatcccagggaggcacaggaaattggaaccccaaacatgtccccagaatctattctgtcctcctaagcctctgggcttgtgatgtgggggcagcctcaaagatttctgaaaagcctttttgacctttttttctattgtttgactattagcacctgactccctttagtcacgttcatctcttagcaagtggttttactgcagtacccttggatttctctccttaaaatattcttctctaccgcatagccaggctgaaaattttctaaatatttactctctgcttcctttttaattataaattccatctttaggtcatttcctcgctaccaaatcaggttgtaagcaattgaaagcagccatgtcacttcttgaaggctttgcaccttagaaatttattctctcagataccttagaacagcattcttaaatttgtcctttcattaatcccaagggcataaatgcaatgcaggaaagttctttgctaaggctaataaggatgacctttgctttactttccagtaagttcctcatttccatctgaggtgccatcagcataacttttactgtctatatttctatcagaattttcatcacaaccattgtcttagttcatttgtgtttctataaaggaatacctgaggctgggtaataaattttttaaagtttatttagcttatagttttgtaggctgtacaagaagcatggcagtggaatctgcttctgacgagggcctcaggctgtcttcaatcacagtggaagatgaaatggagctgttgtttgcggagatcacatggtgagagaggaagaataaaagcatggagatgccaggcccttttccacaactggccctcatgggaactaatagagtgagaacttattaactactgcaagaatggcagcaagcagttcataaaggatttacccccatgtctcaaacacttgccaaaatgctccacctccaacaatggggaccaaatgtcaacatgaggtttggagaggtgaaatctccaaactataccaaccacttaatgaatctctaagaagtttccaactttctcttgccttattgtgttttctgagtcctccaaaatcttacagcctctgcccatcaacccgttccaaaaccacttccacatttttaggtatctttatagcaacatctcattccttggtaccaattttctgtctttgcttgtttgtgttgttataaaggaatacctgaagctgggaaatttataaggaaaggggttttgtatggtacattgttccactgattgtgcaagaagcacagcactagcatctgcatctggggagggcctcaggctgcttccactcatggcagaaagtgaagggaagccaacatgggcagagatcacacactgagagagaaagtaagatgcagtgaggccatgccttgctctttctaacaaccagttctcatgggcactaatagagggagaactcattaccatgaggactgcactgagccaggccaagtcattcctggggtgtccgccccaatgactgaaacacctcccatttggccccacctccaacatcaggatcaaatttcaacatgagatttacggagacaaacatccaaactatagcactgggtaactgggtggcaaagagtgtgtatgattggagtagaataatcaggggacttaggagtatagaccaacattagaaatctgctgccatttactaactgcctgtcctttgacagtaagttaaccaagctgcatgtcaggatcttctgtgaaaaaaaggagtaatagctgcatcagttaaggttgcccagtaaaatgttggaggtccagttaaatttaaagttcaaataaagaacaaataactttttcacataagtgtactccaattgttgcatgggacataattatacaaaaatttattcattgcttttgaaatccaaatttaacagggacattgcctttctgttcgctaaatctgacaaccttagagttcatcaggataggctagtttaagccaaagtaatatttagttttagaatcttgctggcaaattctattaaacaatttgttgttcattaagtgtcgtccccagaaaagcagcatctgtgtgtcctagaaacatcggaaatgcaattttagacctactgaattagaaactatggctatagagccaggcaatttgttttatcaagccctccaggtgactctgatagactaaagtttgaaaactactgcacacatttgcagaacatctaaaagctaaacatttttctgtcctgtagcccaacaatttcatgactaagtatataccaagagaaatgagtgcattattcactaaaatatatgaatggagttttcataacagctttatatacatcatggcccatggctgaaataacccaaatatacatcaacaggagaataaataaattgtggtacttagaacatggcacaaccctaaaaagaacaaattttttatatgtgaaacaatctgggtgaaaatttacagacaatattttgagtaaaagaaacacgacacaaaagaatatgtatgttctatgtgattttatttatatacagttcccagatcaggtgaatctaatctattttaatagaaatcagaatagtgtaactggggttgggatgggtggctgtattgactgggaagagaaatgaaatcttccgaggtgctggaaatgttgtacatcttcacctggttatggttatactggtgtatttagatgtatacatttatacatgtgttcatttaagattaatacaccttatatatgttatacctcaaaaagagaaaagaaaaaataactaatgaaacaaatctcagtgcctaaaagaataaaaaagtatgcctcactcctactacttactactttaagcttccatcacctaacccggggcaatcatttgtgtggccttatctatctttaagtgggaaaagcagtacatccttcatagagggagaaagagcagaatagttatgaactatcttactgactccaacacacctacttcttgaagttctatgtaatagacatagtctcatttattcatcctctttttttaaaaaaaacttacactatgaacaaagcactatgttagccatgtgagattcagtgataaaataaaatggtgttgctcttagggagcttatattcaaagaagaaagacattaaaagagattacataaataactagttagaattatgatagatccagtaggattttgaccacttgccttcatcattttcttaaggcattggtgctgcctgggtacctcttttgcaaccaggcaacatcagccaagatatgcatgacacaatctgaaacatcctttctcaccctcttcaacacctcagcagctacatgagccatcaccagttcataaacggggtaaaaagtagaactgtcctagccagtagtttagtggaagacactgagattctaaactgcattagaagctgaatgcaaaattcaaaatatttcagcaggcaaaagaaagtcaaacagggcttaacattcactactggtcctctgaaagcccatgatacaaccaactattgcagttgattgactaaatttgcaagagtagaagaaagagaaatgtgaaggcagaaaagcaacagcaacaataaaaagtatcaaagggtgagagctatatgataaaaataactagaagaatagccaaacatttggaagagaggttctcttacttggtcatccatcagaattgccttggggactgtttacaaaggttgtcgggccctacccacagaatttctgattcagtagatccagagaggggcctaagaattttcaccgcaataattctcaggtcatgctggtgtcgttagtcaccacacattgagacattgctgaacacacactgagaattgctgatctagaggaaggaaggaaatgtaacactgaactgctctcactttccttctattttgaacaagctgctattattctgaaacagaaaacttagacgttctgcctactaatgctattattttttcaagttcaccattaaaatgtagggatgtggtaacagctgtgaaacctcttgcactacactgggtcttccttgagtccactacaaagaaataaatcagtgactcttttcttctttattcttcagttgacccttgaacaaagaaagggttaaggatgtgaagttcaggctcatctctgaggtaaaaatccaagtataacttttgactccccaaaaacttaactactaatagcctcctttgactggaagccttaccaataacataaacagttaattgacacgtgtattgtgggttacacttattgtatactatattcttacaaaaaagtaagctagagagaagagaaaagaaaatattactaagaaaattataagaaagagaaaatattcttactacacattaagtgggagtgaaacatcataaaggtcttcatcctcatcatcttcatgttgagtgggctgagaaggaggagaggaggggttggtcttgctgtctcaaggatggcagaggcagagtaaaatctacaaataagtggacccctgtagttgaaatctgtgtcattcatgggtcaactctgtgtgcgtgtgtgtgtgtgtgtatgtgtgtattaattcggtttagactacaaagggcaacccgctctccaggaaccaagactgatgctggatgatgccatatatacaagatggcatataggaggtgatcatggaggaccttcagtagcagaggctaggaaccacagggttgaggggaggaggtaagtgaaataatggggctaggctagaatagaaagtagtatcatagcgttcatttttatattgcaaatatcttttctctgtgcccttataaaataatatttaaatgtgtttttaatcagtcctaagtaattggcaaattattacatcatcatcataatcatattttctcattcatggaaaagatatttactgagcctttaatgaatgccaatcactgtgcaggttttagagattcactcgtgaatgaggtaaatctactccatgtacttaactgatagagatttaaaactatactcatgtaaccatgtcattcattcccctgtcaggacaaccccgctgcttcccattttcattcctctacatttaattacaacccggtcttctactctaatctctccctgcgatcttgatctatgagatacttgccccttcgtcatcgtttcccttctgttgaaagcaaacctcctctcaatgcctgtaagccccattcaccttatccattctataaggatcatttcagcccttatttttactgaagcctcttacctccactttagtccaaagtcggaactctttctaattttctgtaggacctaatgtgcccattaggcatttaaatgtacacattcagtattgaatttttattgagccatgttatgtgtaagtagtattgtccctttgcaattttcatctatcagaattatggataagatttgctgtcccttcataaaattgtgtttccatggtagtgtcatttaaaggtgaatcattttctcataggaactatgagtgcaatttggtggctgccttttaaaaaataggctaattcagtcattctcaaatgcagtcttgatcagaaatgatcctttcggttatttgctcaagtgtgtgtgtgtgttcaggtcccaacccaagaccaactatctcagaatttccaggtaatctcagaattttgagataacatggcctgaggatctatcttttaaacaagtgcctccagacaatcttacgaagaagcaagtttgggaaccttctggctgcacattaaactaaaaaactgaaggtttttttttttttaaatcagtatcctagaataattaactcaaaatctccaaaggtgaggttttcctggcatattttcttttctatttttacatctttctgtgacatttatttatttatttgttttaatttattttttatttcaataggttttgggggaacaggtagtgtttggttacatgaataagttctttagcggtgatttctgaaattttggtgcacccatcacccaagcagtgtatactgtacccaacatgtagtcttttatccctcacctgcttcccaccctttccccaagtccccgaagtccattgtctcattttatgcctttgcttcctcatagcttagctcgcactttaagagtgagaatgtacaatgtttggttttccattcctgagttgcttcgcttagaataatagtctccaattccatccagttgctgtgaatgccattattttgttcctttttatggctaagtagtgttcgatagtgtatatatatatgtgtgtgtgtatatatatacacatatatacacatatacacatatatacatatatatgtgcgtatatatacacatatatacgcacatatatatacataaacatatatatttttttatccactagttgattgatgggcatttgggctggttccacatttttacaattgcaaattgtgttgctataaacatgcatgtgcaagtatctttttaatataatgacctccttcctctgggtagaaactttgacatgggattgctggatcagacggtggatctacttttgtttctttaaggaatctccacaccttttttcactgtagttgtactattcactatacactattacagtgtagaggtattaactttttactgcatccatgccaacatctattattttttgattttttgattatggccattcttgtaggagtgaggtgttatcacattgtgattttgatttgcattttcctgatcattagtaatactgagcatttttacatatgcttgttgaccatttgtatatcttctttaaagaattgtctattcatgtccttagcccactctttggtgggactgtctggttttcttcttgctgatttgtttgagttctttgtagattctggatattagtcctttgtcggatgtatagattgtgaagatttttttctcactctgtgggttgtctgtgaactctactgattatttcttttgctgtgcagaagctttttagtttaagttccatctatttatctttggttttgttgcattggcttttgggttcctggtcatgaagtctttgcctaagccaatgtctagaagggttttctgaagttatcttctaggatctttatggtttcaggtcttagatttaggtctaatccaacttgagttgatttttgtataaggtgagagatgaggatccagtttcgttctcctacatgtgacttgccaatcatctcagcactatttattgaatatggtgtcctttccacactttgttttgtttgctttgttgaaaaaaaagttgcctgtaagtattcggctttatttctgagttcagaaagtgggggatgtgaaggagcaggaaagatctgcaggactgtcatcagggccagactcgctgcccagttcaatcctctggaaggctgcacagatcccacctgtttacccttaaggtttcacgccctcttgaactctctcttcaaagttctttccaactttctcttgtggcactggttgactattggtcttgtgccggtctttagctttaattggagtttaccaccaattaactgcactgggctgcattcccaagcaacctgactccaggaagatctgggctggttcaccttttatggccacactactctgaacgtgcccaatctcttctgatctcggaagctaagcaaggtcgggcctggctagtacttggatgggagacctctgccatattttctaaaagccgtctttgttccgaatgggcaactaagttaagaaccactgcatagtgtaacttatgagcaagattgctgaacagtcagtgaaaacagggagtttagtacaaagtctcttcatgtatatttcctccatagaagatgtgggagaaccttaaattaaaagaatactcaccaactgccaattcatttcttgtaagtaacatatacacatttcagacaaattggaaaactgaaaagtataggaaagtaaataaagtcactcattaagtcagcattccccatgagcactgtaatctatttcatcctaaccattttatccacagactatatacacatctcccaactgtcggtttgtaacaaaattggttttatttttgtgtactattttaacatacctctttctactaatatagaatatgtattttacatgttacttttttctaaaatatgatattaaggaatatccattattaaatgggtataaaaattgtttagctaaaacctatttctgtaggtttttccattataattaatgccaccataaatattggtacatagggttttatatacgccactggtcattttccagcattattgaagaagataaatataataaaacatacaactctttgtcaagtaaccagaagtggattactgagttaatagatgatcaaataatttttattttctcttcagatatatagtagcagcttagcaaaaattcatggagatatctttttccattgctgtaatgaacacaatttattacaaatatattttaattggctaattttccaagtgaaggagttgtacttaatttatttaatttgtatgactaagaagtgacatttttccttaggcatttgtctaattcttccttttgcaaattgcccatttacactttgtcccttttttttttttttttttggtcagaggagactttttgcctcattaatttgtaggaaatccttacttagtaagtaatagtaagcttcttatcccttttttgctctcatcatcatcctcccacttttaaatcttttgttattttttaaactttaatcaaagttattagtccttggggagagatttctagcttttgatattatatttgcttttcttaatccaaattcagatatttattaattcatttactttctaactttcctgtcacttcatatgtatatttcccatacttatgagtgtgtatacagaaatacatatgtgtgtgcttttaattattctagaatgtattgcaatagataaatgtctactgtatactatattcttagaaaaaaagctagagaaaagaaaacattattaagacagttataagaagaagaaaatattcttactagtcattaagtggaagtggaacatcattaagatcttcatcctcatcatcttcatgatgagtgggctgaggaggaggaggaagagcaggtgttgaaaggggggggtggttaggcatcctcttgttcatttttagaaatattcatttccctcagtgctatttacaaaataatttcaactatttcgctaagttgtgtactgcctttattatatactaaattttttaaattcttttttcctccatttactatcttgttttattgacctgtcttatcctgacacctgtttcacattgtttaaattattgtgactaccttaatagatatgactatcgggatgcacaaaacctacctacttttgcttttataataaatttaagcaattttgtgtcaaacttaagatatgacttaaagataatgaaagaaaaacccaagatatagttaaaatctgtcaattttaattgatatcaccaatatttaactgaaattctcctcttaatttttaagaaacttacttcacttttgtccattcatgttgtataaacaccttagaacttgtgttcacatgtctttggataatttctgtgatttcattcatttctcaccctgtctgcttagagggtggctgtggactttacaaaatacttttatttacagctatggctcataccaaatatgttttagtgaaataaatatttgatttcagtttgtatatcttatataaaaatataatccataccaaaattttctagaacacatttattgcacaattgaagcctgttagtctacagtggatcatgaaatacaggcctataataatctaattgctatccatagtaagagactcttctctggtctcttgcagtgtgtgcttatctaccttgtttatgtattctgccaacttctttaagtctgtattttaatccctagcagttgggtaaacattcataacgtgtgtgtaacaattatttctgaactgctctcctttcaaaagcattgataatcgaaggttaatgcacaatcgaattttttccttcctggatcaagcctataactgtaacactgtgaaactctcagaaattgctctattacaccaagaagcttacactgctctttgacacacaacactttggatggtctgactatcttgttatgttccgattgctacagtaatcagttagaggccagacacatgttttattataagagcaaacagagtgtatctgctctagggatcagagagagagaaagataccagatttgacagcagcagacttctaaaaacagactgacctgaaatataaatttctggagctagagtagttagtgttgtgacaatcagtttacatctaaataacagaatctacaccagagaccactcagcaaaaaaaaaaaaaaaatggtgttttaataagattcttgcgggtttgcatttcttcagccaatacacagcatagcaaaccccagatcaagatatgaaactttgtctttaccttgtgttgagagaatatcacttaggtggaaaagaaatgaaaacgtcaggctttgataatatagcattaaatgataaactgtactgccgagaaagcaaagccattatgttaacagaattgtgcattactatgacttgtgtttactcctgtgctgcacacattttatcctgcctgtgaattctactctctggcctcttaaaaagattaaaagctgtaattttttcttgaatatatctcctaagtcactaattacattccctagactcttacatccttattcatgtgaccatttcttgtattttacaatgggactattgtcagcttaacaatctagctgtaatacccagggaaggccacacactctcaatgctaaatcacattaccgaatacttttttcttagaacttgttttatcgaccacttgagaaggtttaattgtaaaagtgctaaatgagaatcgaaagaatttgttcttttttcttaatttgaagttgctttgcttaaacatgtaatgatgcctgtgatatgcatggcatcaaaataatgcatagacactattcaaatctctgagtgacatgtgtcttaggtaccaatcttgttgtcaaatgttcactcccagggtatttgctgaaaggcttggatttcatttagggactcagttcctgttttcttcttctcaattggataccattcagttctaaaatctaaagatcaaacagttacccagaggagcttctccatgaacaatcactctttattccataaatgatccagatgttcccaggaaattagttattccttggatattacaagttaagtgaaagattattttctaggtattacactattggggatacattgctaataagcataataatattatttaaaatatctggaggatttaatgatctccagttcattttaaatttttatatgcaggaataatatagttcagtgatcctgaaagttgccgtattgcaacagatgttaaattgttgagattaattcaatgtcatgaaaatatgctcttagcagaaaacaattagctgccattcacttaccatctataccaggtaatagactcagtgttgacaagcaatcaaaaaggcacattcctagttgctattatgaggcttgtattcattctgtcacacctgtgatgatctctataggggtgctgagaaacatgaggacgtggtaaaatttcagaactatgtattcagaaaggctttgggaaaaacatgaaatcaatatggagactatgataaatgtagctcatatgacctctgttctgaacattttgtcagatcaaaaagtatgatatgttggccgggtgcggtggctcatgcctgtaatcccagcattttgggaggctgaggcggtcagatcatgaggtcaggagatcgagaccatcctgggtaacacggtaaaaccccatctctactaaaaatacaaaaaattagccaggcgcggtggtgggtgcctatagtcccagctactcgggagactaaagcaggagaatggcgtgaacccggcaggtggagctagcagggagccaagatggtgccactgcactccagcctgggtgacagggagagattctgtctcaaaaaaaaaaatgtgtatatatatacatatatatatatatatatatatacacacacatatatatatacgtatatatacatatatatatacatatatatacacacacatatatatatatacacacacacacatatatatatatatatatatgatatcttgatatctgtatcccatcattaaatattttggccaattcaattggttcattccgcatgggaaggatggttgaaagattgtggccaggaagaataagtcaatctgtcttttgattacatagattagccatttttttttcaaaattgttgtttcagtagtcggaatccctggtgcagctactctaagatctgttcctatatgcattattatctgcaaacattcctacattaattgacttgcccctcagtcaacttcaacatccattgctcttattattgccttttactataaatatattagtgaccattataccttgctcagtgtaacagaaattatatatgctaaagaacaaagtttttatgagcaattacttagaaacaccttagtaagtcatgttttctaaaaattaggaagataactgaattagagtgaaataattattgtctttcactctttgtaaaaatgaactgtttttcttttgtttattatgctttaagttctggagtacacctgcggaacatgcaggtttcttacataggtatacgtgtgccatggtggtttgctgcacccatcaacccatcacctacattggatatttctcctaatgctatccctcctctagccctccaccccccagcaggcccaggtgtgtgatgttcccctccctgtgtccatgtgttctcattgttcagctctcacttacaggtgagaacatgcggtgtttggttttctgttcttgtgttagtttgctgagaatgatggtttccagcttcatccatgtccctgcaaaggacacgaactcatccgtttttatgtctgcatggtattccatgtcgtatatgtgccacagtttttttttctttgagacggaatcttgctctgtcacccaggctggagtgcaatggtgctatctctgctcactacaacctctgcctcccaggttcaagtgattctcctgcatcagcctcctgagtagctgggattacaggtgtgtgccaccacgcccagctaatttttatattcttagtagagatagggtttcaccatgttggtcaggctggtcttgaactcctgacctcatgatccacctgcctcggcctcccaaagtgttgggattacaggtgtgagccaccatacccggccatgtgccacattttctttatccagtctatcattgatggtcatttgggttggttccaagtctttgctattgtgaatagtgctgcaataagcatacacctgcacgtgtctttatagtaaaatgatttataatcctttgggtatactgtttttctgattataatttaagtcacaaatattatagaaaatacagaagttataaaagtattttaaaaatcagccatcactctaaagaaaaccatcattaagatgttaacatatttcttttcattgtttttaaaaattgttgagactataatatatgaacaactgcctcactgcagttacataaaactttatagcaccgtgttttcttaggttgttattatccgactttcaacataagatgttatggctgcacagtgtcccattgtgttagtatgtggtaatttagttagcttggttttttatcttttttgctatcataatataattctatgttaaatatcttagggtaattttttaaaagttcaatttctttatgtgtaatagtttttcaggagtaggatactttgaatttgtgcattaaacatattcttgaaccaagactgaaaatgttctttccctgggtatgcacatttaaagtagatatttccttgatgttgcaaataatgtaatttatagacatatttcacatttatagaccctacactattaataatatgattcattattacaacagtagtgtatatagattccaaatccatttcaacctttaccagctttggataactggtctaattttacaggagaaaaatggtgcatttcataagcatttcttttctctgatactagtgaatttgattcatgcagttgtttgttaaacatccacctttcatatctttaaatcagttatttgttttccatcctctacattttgggcattccttcccttaataagttttgtgaattatattttttcttatccaaacattgaaaatatatggtcatcatacttttaatcaggcatcatttgttttactaaaggaaactttcttgagccttaggacagtgttaaagacttttctgtttctataggaaccatataacgtaacaatgactatcactgaatgagcgctaaggtttttacattaggcattttacatacactatctttttaagtcctcaaaacagcactacaaaataaatattgaggttgaaggacgtttaatagctacaggattttttttgttagacttgattttttaaatattcttatccagtttcataatcaggagtttttgcaatgacttaggtgaatttaaaaatgtccccaagaatagacataagttgctagaacaaaacagcttagaaatagatccacacaagtataatcaactgctctttgaaaaaggagcaaagatgttgctgcaatggagaaaaggttagtctcttcaacaaatgatattggagaacttgagtgtccatatgcaaaaaccagaacaaaagcataaaacaaaacacctagacaccaattcaaaataaattgtatacctacaggttacacgtaaaatgcaaaaccaaaaaattcctagaaaagcgtgaagcagaaaatctatgtaaatttgtgtttggtggtgatattttagatacaatactaaaagcataatctgtaacaaattgatacgttgcattttattaaaagtaaaagcttctgctctctggaagataatgttaagagaacgactagacaagctacagactggaagaaaatatttgtaaagtatgtatctgataagggattgtatgcaaaatatacaaagaaatcctacaattcaacaataaggaaacaatcaatttttttaaatgggcaaaagatctgaacagacatctcaccaatgaaagtacacagagggcaggtaagcatatgaagactctcaacatcattttattggaaaattgcaaattaaaacatttgtagcttcggccgggcatggtggctcaatcctgtaatcccagcactttgggaggccgaggcgggtggatcacctgaggtaaggagttagagaccagcctggccaacatggcaaaaccctatctctactaaaaatacaaaaaattagctgggcatggcggcggacacctgtaatcccagctacttgggaggcttaggtgggagaatcgcttgaacccaggaggcagagattacagtgagccgagatcccaccattgcactccagcctgggcaacacgagggaaactctgtctcaaaaagcaaaaacaaaaacaaacaccatttgtagcctcacagtggagaaacctcataaacattaacttagccaggtaaacaagatcataatcaatagtaatgtcatattgataacatgtactctaagccaagtccaaacatgagaaaatatcaggtaaatcccagatgatgacattctacaaaacacctgaccagtaccactcaaaattgtcaaggccatcaaaaacaaggcgtctgaaaaactgtcagccaagaagaacctgaaaagacatgtcaactaaatgtaatgttgaacactgaatggatcttggtacagaagaaagaacttaggtataaaactaagaaaatcagcgtaaagtatggactttgctaaacaatagcctattgatattattaattgtagcaaatgtaccatattaatgttaaatgctaatgataggggaaagtgggtgtggactatatgggaattctatatagtatcttcacaatttttctttaaatttaacactattctttaaaaagtttttttaaaggaggatctaatggatatggagttttagttttgtaagatgaaaagttctagacctgttttacaatgtgaaaatatgtaacactactaatttatacactgaacaaatagttaagatggtaaattttctgttttcttccacaattaaaactaaaaataaaatattttaaaagtctctaaaaaacaagtaaataaaaatatcccctattcatgtaatgtttctcttttatactgttaatgcagtgaattatgttttctgagtttttgtgtaaaaccaatcttgaatcctagcataaatccatgttttattatcctttttatacatcaatagatttttcttgtttatatttcatttaggattttttttgttcctatcttaatgaaacatagggaattttcttcttatttctcggaaggttcttgtcaaaggtttgtatcaggattattctagcctcatagaatgtattgggatgtgttcctttctttcttttttgctgtaagggttatatagaattggcattattcttcctttaaatatttggattatttttccaacgaagacatgagtttgtagttttatttctgggaagaatgttaaatgtacattaaatttcataaacatatctagaaatatttacatgttccatttctccttatgccagtttggttaagtggtactttcaagaaatatgaacatttcatctaaacgttcaaacgtattgcatggtttttatctgtttgtttaaccacttaaacctagagagctgtgtcaaaatattcaagtgaattttttttttagttctgtgtcctttttagttgatcatttgctgcttcatatattttgaggctaatcagcaacctgcgtatctgacctggattggtgattgttgttcctttatgttagctttatttatcaaaatataatgtccactttgataacacaaattttaatttttttttctggtaagcacaataatctaacattattttccatattggcctaatacacaattttttccatcgatgaatctcttggtgttttttttttaattgatcatttataaaattatttgagagtcaatttttttatgtgaatttgagtttcaggtcggtcataattgcatagtcatatttattactactagtttatttccctcaaataaaataagttccgtcatattggtcactacctattctccatcctcattccaaaacaagatttgttgaaaatctcttgtcattgttttggttaacattacaatttcaaaagttaataattttttatattcctcatatttctttgtttttaactgtagtgatttctgataaaaggcctttcaaagagggctttagttagatgacatttctgagtctgagttaactctaaaaacatacttatgtttttaaataattttgatagatacacattttaagttcaaagtgtgctttttttcctggacatgtacttcttgtttgtgactgtgaagctcttttcctcaggaagctttttgaattttcctttggctttttgtgttattgaatgtaatttgatatgttcataagtctcccctccccaccttatctttttgtttctgtatactctgaatcattttaatctaagatcttatagctctctttagttttaaaaaattattggtcattaatccttcaaatattcttctctttatatatttttccctcctggactattattaattcaatactgacatttctatatatatattctctacatctcttaccttatgtttcttctattctttttatttccttatcccttccagttgcattctgggagcgtgctttgacttaattgttcagctcactcgtttgttctttagttgaattcatttgacagttcaatccttcaattagttaattaatttaatttttaatgctttatacccaatgtttctatttgttttttctttagaaattctcatttttacttgacatttccaatattatttcttatctctacaaagataattattattcctctttaaaattttatattttcctgcatcttattttacccttatatagtttgtcttaaaaatcctgctcatcagctgtcttgaattgttgtcctatggttcattgtctctgggaggtcacagtcacttatactcctctcaatctgggaaaatgtgaaaaattcagaccttatttttttccctttttataattttaaataattaaacatttcaaaacaaaaatctaaaatatcaaaatgtagactgaaccacttctgtttgtctgcctcataccactgaccatccttcttcctcagggatcttgcttgttttttgttactatcttgtcaagtaccaccattctttctgaggaaggagagagtatattagtctgttttcacattgctataaagaactacctgagactgggtaatttagaaagaaaagaggtttaactgactgacagttctgtgtggccgaggaggcttcaggaaacttacattcgtggttaaaagcaaaggagaagcaagcacctccttcacaaggcagcagaagagagagaaccaacaaagggggtagtgagacactttgttttttttttttgagagggagtcttgctctgtcgcccaggctggagtacagtggcacaatctcagctcacttcaacctccgcctcccgggttcaagtgattctcctgcctcagcctactgagtagctggaagtacaggtgtgtgccaccacacccggctaatttttgtatttttagtagagacggggtttcaccatgttgcccaggatggtctccatctcctgaccttgtgatgcacccgcctcggcctcccaaaatgctgggattacaggtgtgagccaccgcgcctggcccagtaagacacttttaaaccatcaagtctcctgagaactcattcattattaggagaacagcatgggggaagcacctccataatccagtcacctcccagcaggtccctcccctgacccatggggattacaattcgagatgagatttggatggggacacggagccaaaccatatcagagagtattgctggaagccactagtacctattgttaaccactttctaccccagctattattagctaggctgtaagacttctcaaacttgagtgtttttcagaagtacttggctagcttattaaaacacagattgtttggcttcatcctcagagattttgattcattagggcctgagtggtgggccccaagggtttgcacttgacatggacccagatgttgcaatgctgggtctgagtctggaatcacatagagaatgttcacatttattaccccaaattctctgtcttgggttgggttagccctgctgttgttgcttctgtttggtctctctcagtgctgatgattgaaagaggcatcacttcacccagtacaatggggtctgatggggagggaggaaacaatgtgagaattcttccccagcctcaactcttagctgctagagctctttctgccatgctggcattctataatctttccaagggttttcacagttttaatttagtaactagaacccatcaaattccttgtttctctgtggcatctcctttaagatagaatccagagtagaaagccaccaacctatgttggttcatcatcttttcagaaatttgaagtctaatgtgacttaaaaaaattcttaaaaaaactgttgaataatatgattttcatatagctatatgccaattactttgataacttcttgtgtttaagattatctttcctaactagctataactatagtaatgtaatgcaagcctatcttgtctaaactcagacaatgtatttcagtgatatgttttcctttatcatctttagaagcttttttttgtcattaatgtcaaattgccaagacaactaccctatgtgggtaaaaaataatgagaccacaccttgctttttttttttttttttttttgagagggagtcttgctctgtccccagactggagtgcagtggcgcgatcttggctcactgcaagctccgcctcctgggttcatgccattctcctgcctcagcctcctgagtagctgggactacaggttcccgccaccacgccccggtaatttttttattttttttttgtatttttagtacagatgggttttcacggtgttagcaggatggtctcgatctcctgacctgtgatctgccctccttggtctctcaagattttttttttaatacaacatcttgaataccttttagattctaatagctgtacaacttagaacacctttgggttttctatcttcacagtgtacttataggaccctatcttgttatttaggttttaaagggactgtattaacagaagaaagatatgtgtctccagagcatgaatgattttgtcaaatccagaacagggtttcaaacactgaaaaatgtcagattattttcaaacactagaaaataaatgatatggaaaaacaatatatgacaatgaggcagataagtgttcatttctggtaatgagggcccctggaccacttatttggtaggttggcctaacatttacatttatgtcaattctttggactataaggaaagcatctcttatggggatgacaatagcaagatacagcgctacaatgaaatctaattgttattcactattgcactggaatgtcaatgaggggatgcattgttcaaaagctggcattggtaaagttattaaattgattggttcatgaaggaatatagtacattagtgagctactcatctgtgaccgagagtatgtattagaaagcgtgccttcataagtttccaacatcataaatcaaggcaagatttagtacacaacactggcaggaagcggcaatcatatattttacaaggctcagctcaagaaagctcaaccttcagtcatatttgggtcagtattttatatttataatttgctccatactattgtcatgtttattatatttggttcttgtacaaggaatttataatatgaatatgattagaactgagcgacaaaaagacaatccctgcagatttctattgagtttcctctatgcttggtaaataaagtgtatttttttgacttttaattatatatgtttaaaaagtgattgtaaccaattttgcattcattcccacgttgcttccataagtaattattctaagttattagatataaatctaaatattgtaaaacaccctaaagctagagtgaaaaagaaggttttttaataagaagaacagatatttttaagcagtaaaattagaattttattttcacatttatactattctagcccgaatatctgcttcttttatcaaatcttatctggtctttcttatctgaatgaatatcacttctctggattttattactttgttttaaatgttttagcactcttaactaatttcacctcatattagagttttacacatatccacttcctctacctattctgtctacctattgacaacaaaaagcatatctggttaattaaaatacttccttttctttcccctaatacacttacagtcatttacgagtttaatatatcttgtgaataaattaatatttatctgatgtcaaatataagaattcataaaacatcaaacaaatgttttggcttaacaataattattacataagtactatattttataaatagtaactaatataagtagtttacacatataatttcggtgctagaattcagtatataattttattagttaccaaactaacatattaaaatctcatattaaaatctcagaagatacttttagtgttataaaataatctaagtaattaataaatgtgtattgtgtatgataaagtttccatgcataagtttacaaatacaagtgcttatatataaattatattattaatgatatatatatgcaaataaattctggaaatacatttacataaaatgtatacacacgaaatcaaccttcttatattcaacaatgctttcccatgcaaacaaatgtaaaaacacctgtaaacattcctatattgtttctctgataaaacattaacatgttagatacagtatgatgtgttaggatgtgcagtagccacgtggattgatagttgggttctagactcagcaacaccaagagccaccactcgtcatttaggaaatagcctaacttctctggtcttttctaagctgccttgtaaaatgagtgtatgaaacttcgatctctaaaatatctatgccaaatagaaaaatctggccctaaatatagtcctaaggctaccatatttttagcagtattaagagctcctggtgtctgtctgtgtatagacattagtgtgaatacaacatgtgttggggaagggtgagatggaaaaaatacacacaagatatactctatcaggaggaggtaaaatttggccagtgtaggtctaggtacacagtagttgatgagcaaacagttaggacatgcctagagttctttaaatttgctagtcagccacagccatgtgaggaggagttgtcattaaacagagaattaaaggatagaagagccaattctgtccattagatatagcctttctggcaaatgaaacaaaaactgcaagtgtgtaaggccaaacagagcttgctattctcttttgaggctttttttttttctggatgttgttaatttgtcctatgtgtctgtaaatcattaggagagaatgtgtcagtacccagtaatccaaaaatcttttgtaaataccattaaaatattaaataatatatgctttaaaatccttcaaaagtttaaaaaaatctaattttattttacataatcaaataatagaatcagagaactgaagggcatctttataaatgtagcccagtggttttcaaattctgcgctatagaaccattaggctcagtttagcaatcccataaggcacttagttaaaattacgttaataaagtctatcttttttattatttttgaagttgtaattttaaatgggaacaacttcaaatgtcctataaaccaaagtattaattaactggataccattaatataacttctgcttcaaatctgactttttgttttctgagtctgaggactatggaatagtttttcttgctctcacatgtgtatgtgtgtgtgtgcgtgtgtgtgtgtacatgaacatgtatgtcatgtgtactaaatgattatttattaaggttgtaactcagtattgttattattctgagcgaaggtctccacgtgcctactcccattaacttataaagatgagtatcctgttacagcatgtgcatgtcatatgtaattgaattttatctaaagttaggacacatatttcttgctatgtgctataattatggtcaataatagattgttcaacaacaagaaaataaaaaatattttcttaatggtaccgtattatgaatgttctaatttttaaaactactgattatttaatgttttgtttgttatttattatactttgattcaaattttgagtttataataaatactgtgattagtgtttgaaattttgaagcaacaattgcttcaaatttttagaatcattttggtgaaaagttatgctacatataaaattgcttaaattattcacagttacttatttgcatgggtcaagacttcttggaattgttcaaccaaaacaaaatgtagaaataaaataattctgccccagaaaaaccaatgagttaaagatgagattaagaagtccttttttttttttttttttgatacagagtctcactctgtagcccaggctggagggcagtggtgctatctcggctcactgcaagctccgcctcccaggttcttgccattctcctgcctcagcctcctgagtagctgggactacaggcgcccgccaccacccccggctaactttttttgtattttttagtagagacagggtttcaccgtgttagccaggatggtcttgatctcctgacctcatgatccacccacctcggcctcccaaagtgctgggattacaggcatgagccacagcgcccggccaagaagggcattttttaaataacttaagacaaatgaaaatggaaacaccacagacaaaaacttatggcatggagcaacagcaattctaatagggaagtttttaagtaagtaaatcaaaaaagaagaaagatcccaaataaacaacctaacattacacctctaggaactggaaaaaaaagaataaaccaatcccagagtcagtagaaggaagaaaataataaagataagagcagtaataaatgaaatggagactagaaagacaaaggaaaagaacaatgaaactaagtgtttgttgtctgaaaagataaaccaagttgatatacctttagccagactaagaaaaaaatatagagagagaaaggactgaaataaataaaattataagtgagaaaggagatactacagctgaaaccacagaaatacaaatagctatgagagactactgtgaacaaatacatgccaacaaatttgattacccagaagaaatagatatatttctggaaatgtataaactacaaagatcaaatcatgaagaaatagaaaatctgaacaaacccatagcaaggaggttgaataaataataatcaaatgtccatcaaagaaaagccccgaaacaaatggctttgttacaggaatagggttccaatccagacctcaagagaggattcttggaccttgcataagaaagaattaagaaagtaaaggaataacagaatggctaatccatagacagagaagccccgagggctgctggttgcccatttttatggttatttcttgatgtatgctaaacaaagggtggattattatgcctcccctttttagaccatatagggtaacttcctgatgtggccatgcttgtgggagtgtagcagtgaggaccaccagaggtcactcttgtcaccattttggttttggccggctcctttactgcaacctgttttatcagcaaggtcttcatggcctgtattttgtgctgacctttcctatctcatcctgtgactgagaatgccttaaccgtccgataatgcagcccagtgggtttcagcctcattttacccagttctgctgaagaaggagttgctctggttcacaggcctctgacagcttcacagccgaattctaccaaacatttaaaaagaaactaatactaatcctcctcaaacacttccaaaatattgaagaagagtgaccattttcaaactaattttacaaggctagcattagcctcctatcgaaactaaataaggactctatgagaaaataatatttcaggccaataaccctgataaacataggtgcaaacgtcctcagcaaaatatagcaaaccaagtttaacagcacattgaagcaattattcaccatgatcaagtgagatttatgcttgggacggaaagatggttcaacacacaaaaatctatgaatttgatacattgtgttaatagaatgaaggactaagctatatgatcatttcaatagacacagaaaaagcatttgacaacatttaatattttatcatattaaaaaactctcaacaaattaggtatgaaaagaatgtacctcaacatgataaaggccatatatgataagcccacagctaacatcatcaaactaaatggtaaaaagttgaatgcatccctctaaaatcaggaaaagacaaggatgcccactctcaccacttttattcaacatagtactggatgtcttagctagagtaataagacaagaaaaagaacaaaaaacattcaaaaaggaaaataaagagtaaaattgtctcaatctgctgatggcatattcctatgcataaaaaaccctaaagaaaccaccacaaaaccgtcagaactagtaaattcagtaaagttgcagtatacaaaagcaacatgtaaaaatcagtaacattcctttatactaacaacaaactacctgaaaaccaaattaagaaatctatcccatttacagtagaataaagaataaatttaaaaaaaaaacatgtaggagtaaatttaactgaagtgaaaaatatgtgtattgaaacttttaaaacattgatgaaaaacattgaagaagagacaaataaatggaaagatatcccatgttcatggattgaaaaagtttatatattttaaatatccatcctacccaaagtgatctacacattcaatgcagtctgtatgaaaatcaaaatgtcatttttcatggaaagaaaaaagtgtcctaaaatttatttgaaaccataaaagaccccaaatggtaaaagcaattgtaagcaaaaagaagaatcctggaggtatcatgctacctgactttaatacctattgcaaatttatagtaattgaaacagaataatactggcataaaaacagacacattgacaaatggaacagtatggagagcccagaaattaacctgtgcatttatggtctattgatttttggcaaagataacaagaatatgcaatggagaaaagacagtctcttcaataactggtgtttggaaagctggagatgaaaatgaagttagacccttttctcacaccatataaaaaatatcaactcaaaatgaactaaagacttacatgtaagacctaaaactctaaaactattcaaaaaaaaaaaaaaagagaaaactgcatgatattgatctgagcaaaggtttcttggatattagcaaaaaaacacaggcaacaaaataaacaaataagaatacgtgaaaataaaaagcttctgcatggcaaaggaaataatagagtgaaaaaacaacccaggaattgggagaaaatatttgcaaaccacacatctaataaggggctaatatcctaaatatttaaggagctcaaacaactcaataacaagaaaataaataacccattgaaaaatgggcaagggatctgaacagacattttccaagagaagacatatatattttgtaatatatattttgtaatatattttgtaatatattacaaaattctcaacatctctaattagcagggaaatgcaaatcaaaaccgcaatgagatatcacctcacatctgttagaatggctattatcaaagtgacaacagataagtgttgaagaggaaatggaagaaggggaaactttgttgttggtggaaatgtaaactaatacaatcattatttaaaactctatggaagttcctcaataaactaaaaatagagccaccatatgatccagccatttcacctctggatatagttccaaaggaatggaaatcagtatgttgaagaaatgcctacacttaagtgttcattggtgccttgttcacaatagtcaagatgtggaacagacctaagtgtacatcgaagaatgaatggataaagaaaatgtagtgtacatatatcaattaaaaatgtagtgtacatatatccttaaaaaagaaggaaattctgctatttgcatcaatgcagatgaacctggagaagattatattatgtgaaataagcctggcacaggaagacaaatatcacataatgtcccttacatatgcaatctaaaatgtcaaactcatacaggtagagagaatggtggttaccaaagaccggagaaggattgggaaaggggagatgtagatcaaagggtatgttaaaagaaaaacttcagccgaattaaatttaatggggtttaattgagcaatgaacagtttgcaagctgggcagcccccagaatcacagcagattcagagagactccaggggtgcctcatggtcagaacaaatttatagacaaaaaaaagagacatgacctacagaaatcagaagtgaggcacagaaacagctggattggttacagattagtgtttgccttatttgaacacagtttgaacactcagcagtgtatgagtggttgaagtatggctgatgggattggccaagacgcagtattgttacaggaacatactcttgagttaggttttcaatcttgtctacctattaagttaggtcatggttcagccacaaggactcaaatatagacgtaccgagtccttctcaggccatatttagctcactttaacgggtacaaagtttcagctgggcaggaggactgctttttagtgatctactgcacagaatggtgaatagaattaatgcattgcatcttttaaaattgcttaaagattagattttaaacgttttcaccaaaaaagttgataagcatgtgaggtgatggatatgttaattagcttgatttaatcattctataatgtaagcatatattgacacatcatattgtacccccaaaatatttacaattattatttgtaaatttaaaaaattaaattgttttgatggtatattattgatggtgtcatacattacttttgactttaaatattggtatattagaatagcctcactgtttaattgaatgtttttataataagccagtataatagatttgatattatgagatgaatttgaagttatacatgatttttctgttttacaaatttgtgttatatacaaggtaggctttttacattttccagggttaaaaaaagggggtaactcattgatgtagatcactctattatttctcccaagcttgttagaggtacagcaaatgattttcagatggagaatgagattctctcagacttttacaagctagttgttttgattggttgtttgtttgtttggtggtttttttggtttgtttttgtttttgtttttctctgagatggagtcttgctctgtcacccgggctggagtacagtggcccgatctcagctcactgcaacctccacctcccggttcaagcaattctcctgcctctaaaacacagttttattgtgataaatttacattttatgtaatgaccaatttaaagtgtacaattcactagttttaagtatattcacaatcactagtctgtctgagtccatagatttgcctattctagacatttcctctgagtagaatcttacagtatgtggccttttgtgtctggtttctttcagttagcatatatttccaggttcatccatgtagcatgtgtcaatactctggtctttttgttttcaaagaatatttcatggtaaggatatcacacattttgtttactcattcatcagctgatgaacattttgagttgtttcttctttttgcctattatgaataataacactgtaaacatttatgtataaattgtatttgaacataggatttcatttcttttaaatatatacctaggagtggaatcactgggtttaagagtgactctattgtttaacatgttaaggaaccgccaaactgttttttaaactggataccacactgccaacagcaatggatgagcattccatgttctccacattttcatcagcacttgctattctctctctttttcaatgtaactgttctgtgggatatgcagttgaatgctattatggttttggttcgcagttttctaattactagtaatgtcaaatagcttttcatgtgcttattggccattcatttatctttgttgtagaaacatccattcagatcctttgcctagtttttaattgggctatttatttttttattatcaagttgtgagacaccagcagtgtttgaggattctacaaactagtttaaacctgtggtcatcattcttgcataacatacataactccatttttaattaggaaaaaaaattaaccaggtttctgtagctaagcaatgttcatcttatatgtgaatacccagtcagataatataacttactgatactactatttgaagatttaaaaatacataatttcatctcctaccaaacccatttgctagctgatattttagtgcctttccaaaggcatgacaattattttcctatgaactttcattttgaagaaggaagttgaaaacaaagagatgttactatggctctcattaccaaagtctacttccaaaagaaaatgatagaggaatatgaatttagaaaatatctcctatgtctctggttgtacagagtgtatgtgcgtatatatatatatatatatacttttgttggatggaatatgaccagtgatctgtggaaataactgctggaaaaccaaaaaattgggatactatttgcaaagttaatatttttacacctgttaattttactcatttaagaaagtataaataattttatcatgcgttcatttccggtgcctggaacatgaaaaaactaaaatataattttaagtttttcgcttactcaggtaaaacctcattatctaacctcaagaccactgaaatgaaaatccagttgtaatcataataacactcgcacagtggtgataggttatatccatacagtttctgctccagtgaaattccattttaagaaaatactctatgctattcagtcgctggacattcattgtaataagatgtcatttgtataagcaatatgaattgcattcttctgtcaagtggacataagttcaagtatgggtgactttgagaaagattctatacatggtagctgaccaatttgttttggtggctatatagcttaaatataacaatggttgatattctatgaaaaatagacaacaaaaaaatctaattgtcattgtttaaatttaaacagataatgtcaaaactccagaaaatatgtgacatctgctaagtaataattctctacatctctatacgcctttttttttttttttttttttttttttttttttttttggcagagtttcgcttttgttgcccaggctggagtgcaatggcgtgatctcagctcaccgcaacctccacctcccgggttcaagcagcaattcttttgcctcagcctcccaggtagctgggattacaggcatgcaccaccatgctcagctaattttgtatttttagtagagacgaggtttctccatgttggtcaggctggtctcgaactcccgacctcaggtgatctgcccacctcggcctctcaaagtgctgagattaaaggcatgagccactgcgcctggccctgtatgtgcttttttataacattatcttatgaaatgtaattggagcattcatcacattgtaattgtacctttgtgtgtgtttgtgtttgaatgcgtgtgtgtgtgtgtgtgtgtgtgcgcgcgcacatttcagagaaacctgagaaataattgtatggaaataattaaaggtatcttatgaaatgtaattggaacttttatcacattgtgattgtacctttgtgtttgtgtttgagagtgtttgtgtgtgtatgtgtgcatttcagagaaatctgagaaataactaagggtatggaatgtatgctttatcttcattttgccagtacctagtacaatgtctgacatataaaagtactcaggaggccgaggtgggcggatcacctgaggtcaggagttcgagaccagtctggccaacatggtgaaaccctgtctggactaaaaatacaaaaattagccgggcatgatggcgagcacctgtaatcccagctactagggaggctgaggcaggagaattgtttgaacccgggaagcaaaggttgccgttagctgagagcacgccactgaactccagcctgggcaacagagttagactccatctcaaaaaataataataataaaaaataaaaggtactcagttccaattcattaattaattactatagttgctgctgttagattggctgctactgctgctgctacaaatactatctctgctattgctcactattatttattgagggctcattatgtgctatactctttttacttcttctcacttcatcatcgtaagtatgtggtactcttgtattgctttatcactgaaaaaaatagggtcacacaaaaaaataaagctggggagaggttaaaattattttatcaaggtgagtattttggtctgctttgtttttttacatttgtttccttgtgtgttttgcatatataatttcctcagaaaatgtgacggtaaaagaaactaggatccaacatatgtttccaaataggtcatagtgaatgggatcagacatgtgaaaattcattcaatctctcatgggcatcgggcaagggaaagggacatggggttgtacatgtgatatctttagttcaaccacctaggaggaaaaagtgtgctttttttcttgttttatttgcctctctgccacaaacccatgtttcaaagcttgttcaaaatgaatactcaataaatattattgataggcagcctacctgccacacatcatctttgataagtgaattataatgacaatactttgggttacgatgtctgccctttgagagaaagagaatttaaagtaaccacggcctatctcagcttgctggagatataaatctcttggcacctattagcataatctacttatggaagagacataaatgtggagcgaaagggttgcaaaatgatttgttgggtactattgttgagccctaatttaaatcacttggttttctccattattattccaaagcctcatctgaatccttctgacattgaatgtactttataggaacagtatattcctataacttgtaaaatctttaatgtaagatttatattatcttcagtaagatggatgagaataattactttaagtcttgttaagttcctcaaccaatgctgttacaaatttgtacaacagaaagaattaaaatgtcacaagatatatttctgagcataacaatcacagcatttaaaaatattcttaagcatagtatttttaaacaaaattcatggattatctttgcatatacttatacacgaggacagtatggttttcttgaaaacattagttacaaccagctttcaggttcatttttaagtatgggccatattgctgtatgtgaaagctgacgtttcaccagagccacagggacgttaaagtttaaaacagcaaatgtaaaatcatgccactggtcatttgataaacttgaaaagagaggacacaaatgtcagtatctgtcaaagtaaacacaattcatttttttattcatagcagggaaagtcatatgtcaaaggaaaaaaagcgtaatttgctgtgagaagaatgccaaggaaaaggacaaaataacatcgattcggtagttagactgaatatacaagaagtaaggaaaaatgtgtattaacacatatatatcagagatgtaaaatttatatgaggtaccaaaacatcatgttatagattcccttctctacataaccaggctgatgctctgtgccaatgtaaataggcccaattattaccgtttctagtgcagcagaaagcaaagagattcacagaaaatactgccttaggctgtcaccatggtggtctcagcaggggctgagctaagcttgagtctacaggactgacccaaggcttgaagaaaccaatgagggtaagacttcacacagagggtcgtgtcgcaagggatttgctaaagatcaaatcctggtgaccaagaaaagcccaatagctagataagaagtgaagtctttgaagcacacctagcagaacagaactagaagaggagttttccaaggtaaaactctgcaaatattctttgaagcaaagatacagagaagatgaaagattttataaaagcatttttggctccttccatggggatagaaggagttctttatggttgaagaagtaagtaggagacaggactaataatactaagaacccacccatagacctttcactaagttactcgatttccattgccttcaagtaatatatttgattgccttatttgtaaatgtgatagctaacttgtcttccttacagaacacctgtgaagattaaatgtgactatgaacataaaagcactctacaaaattaaaatgtatttacaaatggggaattattattctgttaattttcttttattttccttcctttcttcttttcttacattcaacaaatatttcatgagcatctagcatgtaccagacattcaatgccctaagtgaacagtcaaatcttcttcctctagggagctcacattcaaactggagaaacgtaaaacgaaatgctgcagtagatgggactagtgctacagaggacagtaaataagaaaaaaagaactggagcaatgataagaagtgtgggggtattgaaattttgacagagtatccatggaagtcttccccgagaaagtgacattttatgcaagactaggagacatgaaagaatgaatcatgcagatttctaggagaagactatccaagcagagggaagagcaatcgcaaaggccatgaggtggaagaatgttaacatatctcagaatctccaaggggagctatatggttggagcagatagagggaagtaagtaggatatcagtttagaaaggcaatggagcagcagatcacatggaacctttagggtcatggtgaaggttttggcttttcctctcagtgtgggagaaacaggacatagctaggcaactcagtttgttacattgagaatagacagaagagaaccgatggttaaaactgggctcctgttaagaaatatactgaaagaattcagttgtgaaatgatttaatgtggaaaagagtggtagcagtggaactgttgagaaatgttaagatttttggatataagaataaggtagactcaacaggttagctggagtcttgggtgaaggttgttaacaaagagactaagtagtctgagcaaacagggggctagagttgacattaactgagatgggaaaactggagagaagaaattctagggaggaggaagtggtaagagttcagtttgggactttctttctttctttctttcttttttttggacggatttttgctctcgttgcccaggctgtagtacaatgcatgatctcggctcactgcaacctctgcctcccgggttcaagtgattctcctgcctccgcctcctgagtagctgggattacaggcgtgtgccaccatgcctggctgattttggtattattagtagggacggggtttcaccatgttggccaggatggtctcaaactcctgacctcaggtgatccacccaccttggcctcccaaagagctggattacaagcctgatccaccgtgcctggccagtttgggacattttaacttagtagaggcatattaaacatccaagtggagatatcaaggagacttttgatataaatctgaagattaggagagtagatttggttgaattcataaatgtaggcattgttagagtagaggtgaggtggtctgtaaatctaggtgattggttaagaccttcaagggagtaagtatggacagagtagagatctacaaattacctgagaggcatacctatgtttccacgtcagaaagataaagaggaggccgggcgcggtggctcacgcctgtaatcccagcactttgggaggccgaggtgggcggatcacgaggtcaggagatcgagaccacggtgaaaccctgtctctactgaaaatacaaaaaattagccggggacaatggcgagcacctgtagtcccagctactcaggaggctgaggcaggagaatggcatgaacccgggaggcagggcttgcggtgagccgagatcgccccactgcactccagcttgggcgcagagcgagactccttctcaaaaaaaaaaaaaaaaaaaaaaagaaaaaaaaagaaaaagaaagataaagaggaacaagcaaagaaaaccaacatgggacaatcaaataattaggacagttaggacagtgtggtaatttgaaaaccagatacagaagatatcccggggacagggagcaatgcactgtcaaatgcttatgattcagttgtatgattcactgcaacctccacctcctgggtagatggttgaatgaggatgaccacttaccacctgctatggtttggtttgttcttgcccaaactcacgttaaaatttgatcccaaatgtggcagtcttgggaggtggggcctagagggaggtgtttcagtcatgggggcagatcctttatgaggacagagtaatgccctcctgcagggttacttttttgcactccagtgaaggggttagttcctgagagtagcttgtttcaaagactctggcttcctcagtttctccctcttgtttcctctctcaccatgtaatctctgcacacacctgctccccttcctctttctccaatatgttgaagcatctggaggccctcaccagatgcaacaggctgatcttgaactttccatccattagattcatgaaccaaataaacatcttttcttcacagacagcccagtctcaggtattctgttacagcaacacacatggactaagacagcaccacacacaacaatgcaaaagccatttatgatcttgaccagaggaatttcacctcaaaggtggaggcaaaatcatgataaagttagtttaagaatacaagagaaggctgggtgcagtggctcatgcctgtaatcccagcactttgggaggccatggcaggtgggtcacttgaggtcaggagtttgataccagcctgatcaacatggtgaaaccctgcctctacttaaaatacaaaaattagctgggtgtagtggctcatgcctgtaatcccagctacttgggaggctgaggcaggagaatcgcttgaactcgggaggcggaggttgcagtgatccatgaccacaccattgtacaccagtctgggcaaccacagcaaaactcggtcccaaaaaaacaaaacaaacaaacaaaaaaagagacaagagagaaagtggagacagcagggtcagtaatattttcaatgagttttgctaccaagagaagcaaaattaataataataataggggatataaagttgagccaacattcttattttaataaaaaaaatcttccattaggcagcattcagaacagaggaaaacaattgataattattggaacagtgctatggagcaagtgagaaggcatggatctggtgtccaagtgagttgtcctgagatatgtttgggaactctgctctgtggaagcaggaaggccagcagagtttgtggacacagatggatttttgggtgaatgtggtgcagagagcccgcagaggctttcttctgagtggtctggattctcagtgaaatttgaagctaagaggaagactggcatagagggttgggcttaggcagaagtggtatatcaagataagtgcatggaattggggaatgggggacaaggcagggaaagtatatgtgaggaaattactatgaatgatcatgtaagcaaggtaaaaaggaaaatgagaaatgaatggtgcagggtgaaagtgaagaatagtgaaaggctggaaggtttataaatcccagggaggtatgttttcaaagctgcttattggtcgtgagacccaaaagtcttggtcattccgtctgctaaaaagtcttcagtttctttgtatccttatcgcctctgccttatttaacattatcattatcattatcattatcattattattattcccagggcattttccttgcctcttctagagtgctaaccaaaatatcacagaacagcatcatgagcatcacttgggggcttattagaaatgcaaattctcaggcctcgacttaggcttatcgaataaaaatctctaggactggggctcaggtgattcttctgcatatcaagtgtaaaaatctctgctcttactgcatataacatacaaaaatctctgtccatacagccacccaagggattttccacataagcaaacctcattatgttctacttttcctcaaaaaaatttgagcctgctttacctaaagcataacatctaaaaatgtgtgcttagctcattcccatatttacacctgtgctctcgtcttgttgataatatcttcatgtcttagcctctgctgttgttggctctgaaaggtattccttatcttgctatacaggcagaaaaaaatttattcagttttcacatttaagctgagacctgttctcattcctcttggtcagctcagatgcttttaccctatgctttcaccaaactttatatagacttcaattttaataggcatatcattatattattaatttttacatgtattgccctccactaaacagaaagctccttgatggtaagtatatttttcttttatctttgatgtccagcatctcaatcagttattaggcagtcactatatgttcttggaagatgaataagatattccaaagtaaagtggtttctgcatttagatgctctgccatgtctgaatgtgacttacaataatttattatatgttatacacatccagaaataatgaacaatctgtttataaagtctatttccttacaccaggtcatttatgaatatgttaaataacaagatacttataatactttcatttttcatatggtaaagccaaacgtttactaatttttcagcaagactttgtgatttgagtgaattatttttcttgaactataaaggatttttccaaccattcagattctttccccagagtacccttgcagtacctgacaatatttgcctattactttgtcaaggcaatgtgagtgtttctgtggttttgcaacaaggtttgccaatttgaacaatgattgaagtcatgataatgacctcatcaatttcacattctagactgagccaaccaattccgttcagatttgttatgcatttcatttcatggggccatactaagcaaacactttcctgttaatctttgacaggtgggccaactgacacatttaaacaaatgaagtctttttatttattgttggtagattaatagaatcatctgataggtaaaaccccaaaaattttggtgtagtttcaacacttctggctgatgtcatatacttgtcacacaataatgcagactcatattactcttgaattattacagtaaatgtgtgacgtggtataaaaaacagaactacataatactctaaagtattaaaggcatatgaaattttggggaagactacttgttttggaagagcattactaagtttacaaaggaatttacatagcttcctttagtattttgacaatataaggtcattgtttaaattttgtttttctaaattatacagagattatatcaggaaatatatatatgtgtgtttgtgtatggtgtgtattcacacacactcatacacactaaattaaaggaatgagtcaagaattcttttacaaaattataaaccccttggattgatacttccaaggataatctgcttgacttcttgaaattcttgacatctgtattctgtcttccttggcacatgctagactgccctttccagcattcctgtagctatgtgtgatgatgtgactgagttctggtgaatgcaatgtgaatggaaatgatatgtggttcttccaggcaagaaccaaccaaccaaacaaacaaacgaaaaaaacactagccgacttttcctgtcattgggctgaatgaacaagagtccagggatctaaaggatgcacctggctccaaactgtttcaatagagaagaaagccccccacctccagtccccactaaccctcattaaattacgatctaatcaagatatttgcattgttttaaaccactcggattttaggattcatctgttatagatgctattattatttgccttaattatcatcactggaatctactctcaatagccaacagtcagtcttatcccaccctttatcctaccctaggtatggttgaatgtctaggttctgcttggcaaagatgatttagacaataaaggagaaaaactggaaacttggacagcgatcaaggcagaggatggccaagcttagcctggagcatgcacaagttttcaacataattgcaggcttagttatggccttaggatgaaataagtggaaagctaaaatggagaaataaattaagacaaaaatctagatatgacttaggtaaaggtgaagtctgtgacaatgatgagaacttgctccagaggttttatagcacataggtttactggtcaaagcgatattttagcagctctgattctatgtagctgattcatattttaaaagccccaccttataagagtaaaaactattttctgtattggtagtatttttatttatcgaactcttccaatatgtatttgatgaaaatgataggttgtttgccacattgaggagaaatagggacacatcatatgcaggccagatagtggctaatctcctaataattatcagattgtctctggacaagggatcaagtttatctgaactttacctacaaccatgccagctaagcagaactactcatggattttcagttttttcatttaaatttgtatattaatatgtgatcctaagtaatgatgtatctaaagcatctttgtttactttacactaaataaattaggatttaacaatacagttgtacaatttgtttttttgtccaaccccaagattattgatctccaggaactgaatccccaatgctcaagtgattcaacactttaagacaggcaagtaatggatgactgagttaaacacaaggtagagagcacatggaatatgcatctaactggtttaattaagttagttccatctaactaacttccagactaggaagctgaggagcagcaacaagaaggctctgtttagagggtcattagtaaggaatagacaactcaattaggtaatccagggagatacattttgtaacatgtgttttataaacataactcagctcaatacatacccgattgaaataaaagagtaaaatgtgagcacctcttgtgtgtcagttgtgacgcctcatgttttactagtgttatcacatttagagcttagggcggtcttgcaaaattgacaagcaatttgagagataagaaaactaattcaaattttgaggtcacatttggatactatgatttatggcttgctagtcactttcacaaagtgattttttacagccataatttaactttctatttttttaaatcgatttacctcttgtcttggcaaataggtaaactggattataattacatggtaccatcataggttccccagaaaagggtttttttaatcctctcaaaatcaccaccacttgctcacttatattttgaatctgttttagaaaacataaaactttctttctattattagagctctagctttatatgtaaaaacacctttggaagaactggcacattaaaattgtttcacacagagatgtaaatgggtgccaatcttcattaagtttgctgtgacataaacaaaattatactttttctatatcatgactaaaaagtaaaagagcgaaagtagactaacaaaatggagagaaagatgccataagatttcgcaagaaacacaggaaaaggggggcaagggatattaaaccaaaatatgagattaattcccactttttctaaggcacaacttcagatgtttaatttttcattactaaagaagataacgatcaacctttaaaaataattgtttttccatattatctttatatctgttttttatagtgagacattcatgttttgttcattcacttccatgatgcacaccttgcactgataaaatgaccaaggcacccccaggactcatcatggatggtgacgaaaatcaagcctgaaaacttggattcagtgtgtcatcctttatagtagcacaatttagaaacaagttagactattatgaataagttgtttctccacagattattttctgttttgttaaaaccccatttagaatgagattgattgaatggtaatcacaactattctagttgccaatcactctttgggcttcactttttgttattgtcctagagggtcagcagctgtgaacttgttctcattaattttcctgacaagcgctagtttacatagaaatggttgagtccaaactcaggaccaatttgaattcatttgaagttagggaaacaactgattagggcagacctctaaattcaacagatgttacattcagttttgcaaactgatggagattgaagatccgtggcctcagtggtttataattgcactctagcacacaattgattattgtatattatttgtcatttatatggtatgaaagcctggagcctttgactcatagatgaatgtgtcagtgaagatgctttaggtatcctactcaacccacccttatacacaaaaagacttatttacctagcaggaatctagaaacagggtggatctcaggatgatggatccattgattccatgccattgaggactgcaacacatatttccccacagtgccagtttcatcctgtattgactctcatggtgaagaatggttactatcagcaattggacctacatgtttctttgtatatatctaaaagctgagaaagaaggtttctcttcagtattctaatcaagaaagtgttctatgatttagcttgattggattgtctaagtcacatgtcaatagttaatagtgactgcgactggggaaatataatgtgctggttatattgcactaatgcacataagctccataacagaagaatagacgcattgcagttcttttggaaggacgaaggggtcaatatttgctaatcacacaaccaaaaatatcaacgatagcctctgtccagcatccagaacacagtcaggctttgttcttcatttcatttttgcattgcattttgtaattttgtttatttatttttatttttgcagttaatgaatagtaatatagtcatataccatgtaatcatgttttggtcaacaacaaatttcatgtatgacagtggttgcataagattataatggaactgaagaattcctattgcctagtgacatcacagctgtcttaatgtcatagcacaatgaatttctcgtgtgagtgatgatgatgctgtaaacgatcctgctgtgctgccagtcatataaaagtataccacatgcaattatatatagaacataatccttgataataatgttactcgtttatatatttaccatactagatttcttatggctattttagtgtgtactcctacttattaaaaaaaagttaactgtaggccgggcacggtggttcacgcctgtgatcccagcactttgggaggacgaggcgggtggatcacgaggtcaggagatcgagaccatcctggctaacacggtgaaaccccgtctctactaaaaatacaaaaaaattagccgggcgtggtggcgggtgcctgtagtcccagctactcgggagactgagacaggagaatggcatgaacccgggaggtggagcttgcagtgagccgagatcgagccactgcactccagcctgggcaacggagtgagactccgtctcaaaaaaaaaaaaaaaaaaaaaagttaactgtaaaacagcctcaggcaggtctcttaggaggtatttcagcaggtattgttatcataggagatgacagctccatgcacgttactgctgctgaagactttccagtgggacaagatgtggcagcagaagaccgtgatgttgatgatcctgaccctacggaggcctaggctaatgtgtgtgtttttgtcttaatttttaacaaaagctttaaaaagaaaaaaactaaaataaataaacttaaacatagaaaaaagcttagagaataaggatatgattaaataagatatttttgtacagctgtgccatgtgttttaaattaagtgttattacagaagaatcagaaagttaaaaaatttagtttataaagtaaaaaactgcagtaagctaaggtaaatttactaccgaaatttttaaaaatgaatttaataaagcctaggtgtgcagtgtttgtaaagcttacagcagtgaacagtaatgtcctaggccctctcgttcactcacaacttactaagtcctgcaagctccattcatgataagtgcaccattgtttgccttttacagtacttttagtgtactttttctatgtttaggtatgtttagatacacaaataccattgtgttacaattgcctgcattattcagtagagtaacatgctgttcaggtttgtagcctaggggcaataggttattccatgtagtcttgggatataggctaaatcctttttatccttttttttttttttttttgaagcagagtctcactctgtcacccaggctggagtgcagtggcaagatttctgcacactgcaacctccccttactgggttcaagcgattttcctgcctcagcctcccgagtagctgggattagccaccatgcccagctaaattttgtatttttagtagagatggggtttccctatgttggccagggtgatcttgaactcctgccctcaagtggtccacccccttagcctccaaagtgctgggattacaggcgtgagccactgcacccagccgggatataagctagatcctatatagaaggtagtggtctatacaccttcaaggtttgtgtaagtaggccctatgatgtttgcaggaaaacaaaaatcacctaacaaggtatttctcagaatgtgttctcctcattaagtgatgcataactgtaaaatgatagtaagaaatatacatatataataatatataaaaaatctgtcgtatccataaaaattaaatggaatgttttgagaggcttgacacaattaagtggttaaaaactcttgtagaattcatgttaaagaaaaaaatataaaactgacaggtgagatagaaaaatatctagaaggatttgcttttttttttttttgagatggaggttcgctcttgttgccccagctagagtgcaatggcgcgatctcagctcactgcagcctccatctcagcctcctgggttcaagcgattctcctgcctcagccacccaagtagctggggcgacaggcgcatgccaccacgcccagctaatttttgtatttttagtagagatggggtttcatcatgttggccaaggtggtctcaatctcttgacctcatgatccactcaccttggcctcccaaagtgctgggattacaggcgtgagccaccgtgcctggctgaaggatttgcaatcacattattttgcaaacattttaaatgttttaatgttttactcttcttttaaaaaaatgaaattagagaccatagaaaatatattgtggcatgattatactgaaaggaaaaatttgaacttcaactaggggctatgcactcaaagaagaaacatttctcctgcatcaaataactagtgaatggtgtctagtaaaaatgcgtttgtgctaatacaaaaatgttaagatgtgcttattatttctatcttaacttagcatttttaaaatcagtgaacaattgctttatttatttattcatttatttatttatttgtgatggagtctcactctgtcacacaggctggagtgcagtggtgcaatctcagtgcgctgcaacttcgacctcctgggttcaagcaattctcctgcctcagcctcctgtgtagctgggattataggcatacaccaccacgaccagctaatttttgtatttttagtagagatggggtttcaccatgttggccaggctggtctcaaactcctgacctcaagtggtccacccaccttggcctcccaaaatactgggattacagatgtgagccactgtacccagccaatcaattgctttaaataagaggacatttaattttaagttagaagtttaaaataaatttaaaataaaccaaataagttttacttgatttaatgaaagtgaaataatttgaagtagaattctgaactttgcataaatgtttattatatgaattttttaaatgctcaacaatgtttacaaattaaaaatcattaaaatgttgtaatcaatttaaactacatatttcatttttacagcattagttgattctttgctgtgaaatacatgattagaacttttttcccctccctaattttttcttctaccttccctctgattttgttgctttattcagcatttatataccattctatagctataatttttctattattttgtctgttatatttaaatagattcaatgcatactgcaacttctaccatggtatctccatttcgtagttattttaatgtatttcttggctgaatttatcattgggcaggtaattttttcccaagaaaaatgtgagtgcaatattcctcgaaggcttttcttgttcacatttgaaaatgtctgcctgttgcctttttcctcaaatgataatgtaactggaaataacacagaattgttgaatcatactttcctttttaaactgtggatagttttacattgttttctagcatagaatatttcagtggagaagtttgaaaacagcatactttttcccccttgtaagtaacttctctgcaaaaaagtatttcttcatccttgaagttcaataaaagatgaattaggatggatatgcatgctggtggttcagtgataaattctcctagtattttatttattgtgcctatttagtttgcaggttcaatgatctctcatttcaggagttttttcctatgttactttcctcattactattttccattccatttgttggattttctacttggagagcatcaattatctttaccttcaatcttctttgtccatcttccatatctatcatcttctaattgctttgttctctcggtctttttcttcacattcactctgattaattccatctatgccagcagcttgatagtcaagaatcctactttgtttattttggctttcattcatttattatattaatatctgtagcaaaattgttttgatattcagtttgctttgataatttttattctgctacttattaacatttttctcttttattgaattcatgtttatattaaatatgtttacatcttgtgcaattgtctctgttgttttatattttgtgtgttgtgatcctctcaacacacaccctacccttgaccaaacacgcttgcaaagttatatgccatttttaaaatctcattcatcattaatttgggcagctctgtctacaccttctatttactttgttataatgtaagtgaatgaattcttcacactttcaccatcttatctagtacctttgcttttcctttgaaattattatttgaacggtggatactaaaaataatctacttttttatacctgaagtcatgaagacagctttatcttggataaagctgagaccattccttgttggagcacatagctccattctcttcttcgaaactgaatgttttgtactagagccagctctcctagacaggtaggggttctgcaagtcagcaacctcccacacctgtcccccacctcaagaaagcaatcactctgagtttttctacctctgccaaagtcctacattgctgtgtaaaatcctccaatctcaagagctattttcattctaaaaattttccctggtttacttctagtattcttaatatatttctctccaaactggagaaatattattaaggttatcagctaactcctcttctttcctcgatactgttgtacccaattccagaattttcttttttcttttttttttttgattgccactttttgatgtttatatttatttgctgatggtgaatcttatcaaattttttaactggttttgtgcttttttggtttgcaaatttgggagggagattttgcaatactgcctccctctgacatcttaatgcaaaatcatctgatctctaaaattctaccagacatgacaaaaatgaagtaaaagaaaagaagtacaagtgagtgagggtattagcagtttttcagtaattaaaagtagcatgatgaatttagcagtttggatcgctgtcctgacattggcaacgttaatcagtaaagtttctacgatgacggaaatgttctatatatttcctgtccaatatggttaccactagccaaatatggctattgagcacttgaagtgtgactggtgtgagtgaagaaccaatatattctattatattttaagtaatttgaattaaaataaaagaattcagtaggtctcattcagtaggtcggggaaatgaccaatgacctgatactgcctatccagggtaccacactttgaaaagctctcctctatataaccaacgtttctgtacagattaaaatcacactgttgataaaattgtgcaatcacagggaaagtagtagttggtgcaatatacttgtctataacaacatagggattctcaagaatctcaggacataatctccagtaacagacaagacactactctttgttctttcctcacagaaaataaccaccttgtctctttcccattcctttcaattgttacctggtgtcttgtgataataatagaatcacaaacttccaagtcctggtttcagctgtagaagaccctttaaataggagttgggttcattcccaaataaaaaatgacactaatattttaatataggtatatatccaaatgatttcttcatgacattggtagataattttataactcactaaaggcaaatactttaatgaagaggaatgttttatgtcatgcatgcttgttaccatcaacaatataagaattatagttatttccttctgtaattcctatccctaacacactgttgacattttccatgctggaccgtataattcagtatggctcctctcacacaaattaggacattttgtcatgttcaaatacagagaaagacatagcctagcatttcctagagaagaaaaattgtcagcattttcttccactgagcaatctcaccatatagtttcattgatctaacagctgatcatattttctaaatcagttgaattttggaaccattttcagtagtgttttacagagacattttctctagcttgaatatttaaaatggtaaatattgttatctgactttattaaaaatgttaatcaggctcattggggaaagagaatcaagataatcagaacagctattctattttttaaaaaaatttaattaaaataaatttaaaaattcttctaaaatcttaaaatttttaaaattatatgacagatcccatcagttctttccatcagttttgatgtttcctatcattttgttactgttttaacaaatatgtaataaaaatcatgatgtttattattattgtttgagtctattgtttggtaggctttctctattcttgctatagatttgtactcagttatcttaaatttttgtcactagttgagtgaagatatttgatatttagtgggaattactaaacaatctgtcacgtttgataatgtgtaaatatgttggacatataatcttatattttgaaaacttgttattgcaaaagctatactttaatcttgaaagcaaatcaccaagtgagatttactcagggttcattttacatttttgtagcattcatggatgaactactttgaagattaaattataagcaataaaaattaatttactacaatagtaaatataccagtaaattagtaggaaataatcacttaaaacttatacaatacaattttaattatgtagagtccatgtttagatatattttctttatgatatacatgggccacaatcaagcatattaattttctgcctgctggcgcaaaagtcggttggtatcttcctaagaaaattttgtcagtttctatagtcttttgcaatcgtgtatattctaagacttgtttggttttgagtgttaagtctctattaatcaagtataatgaggataatctctcttacattattttaaacaagtaattttatttccctaccttccatcatttttctttgttttagctttatcaatgtataactgacaaataaaacttgtttacaagcaggatgtacaacataatgttttgatatgtatatacattgtgaaatgtctattatttttcttgattcctcaatcagacagcctatatgtgaggacagtgatgtgaatataatttgtgactgtgtgtgttttacctctttatccctgctaagaaaatagataaggaagttaagtggaaagagtatctttatatgagtaactatgaatctgatcttatttatcttttaataataatatagtcacaaatcttctgttctctaacactatctataaatgcctattgacacttttttaatatccctgtaaaattacgttgacactcaagaatatggttaagaggcatttctctactgagttacaaagattttataaacaaatttaaagggcaagcgatacattaggaaaaattatctgttacctatatgatgtacgaaaaagaaaaagtcacacttcatacagtttctagaacttagaaggaacaaaaagaatctactgaaaaaaaaaaaaaaagaatacaattcagaaattccctgaactagaaatccaaatggccaaaacacaatcccaggttcaattaacaaatccaactcttaacaataatgatacctcccagagcgctgcaggtataagcatgagccactgcaccccacctccacctttcctttttaactatcagtttcatatgcctgatttttttttacaataagcatgttatatttgtaatttttcgtttaacttaacgtcaataacgttttatactccatagtatagaaaaatatagtatacctattcttttatatttaaagaaaaaaatttaaattaaatgcagttttatcgaaatatgttgtgtcatttttttttttttgtccaaaacaacatagctgttctgcagtgagtgtatggagacaggtgttatcatatactattgataggagagtaaattggcccagtcatttcagagggcaatttgactgtatttctcaaaactctaaatgctcaaatccaataactgataaactctatttctaagaataagtcctgaaaagactttcagctggggctatacgatgtctgtgcaaagggccccctaccacattctacgacatttttatgtaacagtaaaatattggaaaatacctctgtatccaagtctggtaaaataattttgttgaatcaatataatggattacttgtagccaataaaaataagaagatgtgtgtgaaaaatgtatcttttaccgaaaaaaaagcaagttgaaaaaacaaaatctagttacaatacttttttacataaaagatatacacataagtgaatacatatgtgcatgtataaatgtatgagcccatatgatcgtaagaaaaaggtctaaaatggtatactctaaatagtctactactgggaattcggactgagtggctaagtgagacccctttctctttctctttctctctctccttcgaaaccgggtctctctctgttatccagactggaatgcagtggcacaattatagctcactgcagcctggagctcctgggcttaagtaatcctcctgcctcagtttcctgagtagctgggactacaagctcatgccatcatgcccagctagttatttttgttttgttttgttttttgtttttgtttttttttttagatagggtgtctcactatttctccaggctggtatcaaactcctggcctcaaatgagtcttctcctgggtcactgggattacagtggtgagccattgtgttccacctttctttttatttttgagacagggtctcactctgtctcccaggctccagtgcagtggcccggatctcagctcactacaacttccacctcctgggttcaagtgatcctcccacctcagcctcctgagtagctgggactacaggcacacaccaccatgcccagctaatttttgtcttttttggtagagatggggtttcaccattttggccaggctggtctcgaactcctgacctcaagtgatcctgttctgtcctgtaaaaaaataaaaaataaaaaaacactttcaataatatgcagcaagcttttgtttgggaggggagataatatgtaaatttaaactattaacttttctttaaggattactacaaaaatagattttaattcctatcattatggactattaacattttatattctactatttcaagcagttatgctaatttattttagagattcttcaactcttcttttccaacaaatattttataatgatctataaagataaaaaaaacagagccagtaaattatgactttcctgttatactaatgccacacattttatgattgtagtgacggaggtgtctgtcatgaaacaatgactaattgtaggaagtacaagccttctttaaaattaatgaagcttcagcaaaataacaaaatatgaaaaaaatcaaaattattttttacttcaaatatacatttttttcttttttttttttaattgacacaaggtgtcactctgtcacccaggctggagttcactggtgccatcgtggctccctgcagcctctacgtcccaggctcaatccatcctcccacctcagcctcctgaatagctgggactatagtcgcatgccaccatgcctggctaatttttgcattttttttttttgtagaaatggagtttcgccatgttgcccaggctggtcttgaactcctgggctcaagcgatctgcccacctgagcctcccaaagtgctgtgattacaggtgtgagccactgcgcccagccaattttgcaaattgaactttcaattataaaagattatttgtcttacttaagcattgttgtcctactaaactattatttctatgcattaattatgccttggtgactttaggtttgaaatcaaaacccattttcttttatataatattaacaacactattcagagctaagacgcattataactaatgatgcattatatacacttgattattaattttgctttttaagtgaataggaagagtggatatgaagagaatgcccacagtcctcattgctgtggagatttgctttccacgattttaaatcagggttatcagaaaaatccagtttctccctagaaaggtttaattagttacatttgttgaaaagtttgacacattctagatgctttatatttaagactgttttataattaaatgccatattatgaaagctcttcttgcttctgtattaacttattaatggatattgaattaaaatcataaaacttaatcctcactgttgaatatttcttaaatctcaactaataaacagttggcatatggacattcttattgaaatataggacatttttactggtgaatacatttttccacttaaaagtttttatgctgatataatataattggttccattaagctattataatataaattgcattcccctaaggtcattttagcctttatacatggttaaaggctttcatgagttatataaaactcagagctgtcaatgaatttactattgagtagcagactgccaagtagactgaacaactgaaaaaggggagaaaaagcaaaataatgataaaagtagataacatttatatagagctcactacaagtcaagcactttttaaattgtctcatccatattaattcatctaattctcatagtgatcttggaggttgatccccttatcatccccacattgcagaaactgaggcctggagaggttaagcaatttacctgttgtcatacaggcagtaaggaattaagctatggtttaaccccagatattctggctccagagcccatgctttgacttaaccactcttacaccgcctctccatgcaaattgctgttggatgattgaaatggtatgggtgcttagaatcaagtgacatataaggctgcagacaaagacagacctaagattttatcattttaattcactaccactaaacaattggccagaacttggactttctggccctgtacttatttctttcatagtctacaccaacatatttgacatgattccattatgctgccacaagtgatagactataaagagaagtagttatttgcttctaatattttgccagataattaatatagaaaatgatacattttttctcatcaaatgcaccaatgcatttttcactggaatatgaaccctggtttgcagaatggggctagtctggggcaaattcgcgactgccgccttgggttccaaagaccaggctgactcaggaggaatattactcaaggtaactgcagtttgtaaaacatgagcaaaaagaataaaaaaggaaaaaaaaaaagatcagagctgcaagtcacttgcatatggcaatcctgcaggcatgttaagaatgaaaacagctgggtgcagtggcatgcacctgtggccccagctacttaggaggctgacacagaaggatggctttaggctaggagttcaaatccagcttgggaaacatagcaaaaacctgtctaaataaataaataaataaaacaggatttaaataggaaaatgactagtgaaggaacccatcaggcaccattgttctagtcaaaactttagcattatcctagttggttatttccctcacttctctactgtgatatcagagcctttaggaagccttgaggttcatttccaaaacaaagtgagacatgcccgtgtttgccattgccatgactcctgcccgctattccaatctgtggtcctctcttcccaagagctcagccttggccccagctatgtgtccatttccatggcttttacacttgccctctcctaggttgtatccatgacacacagcagaggtttttaaattagaaatgagatcatatcactctcctgactaaaactcatttcagtgaaaataagaaagattgatatattcccatatatgttagaagaaagttcaaactccttgtcaaggcccaaagattctaaataattctgcctttctctaactccatctcatctcttctcccacctcctcccatcatgcttacttatttccagttatactgtttccccttcaattctgcaaatagccacactgtctcttgactttgtactttttttttccttctgtcttgaatgctcttccctagctcttcaaatgcctggctcagtctcactcagttctgggctcactgtcaccttttagagaaaccttgctgatcagttatttaaaacagggctccttatttattttctatcacatcaccatatttattttcttcacagcagttgccacagtctaaattatcttgcgtacttatttgattacctgtgtattgtctgctccagtagactgtaagctttaccagaacagcaacctattctgcctcatttgaagtgtgcaccctacgttgagcaaaatgcctggcatgtagtaagcaagtggtaaatgtctattgcatgaataaaactgatggtgaatcagtgtccacaaatgagccaaggaaaatggctcagggctgagaccatgggcaatgaacaagttctttgcactgtttgtgagaatagaaaggctggacgcagtcacattggggttgagtcctcaaactgtaataagcacaaataaaatgatgaaacatagtaaaagattgactgttccctgtccatctatctatcaatcatttatctgtttacctgttgcgtgtgtgtaatgtctacagctttatccttccataaaatgcatctgtatttggtaattttcaaatttaatcattatacgagcataattaaaatataggtgtttacatttcattttaaaaataaacacaaacacttatgagtttttagaatgcacaagtaagtggaatatcttgattctcaatctcagattaactaaagatatactttgtgatgcggcagtcaatttatatggttaaatagtgtatcattgaaatgtttgcacataatatgtgtaacaacgtttgaaataatgaaaccacaaaagcaaaggaaataattttgattaaaagtgaacatgtctttttggaagttaaaataatcaaatggtaaaatttacttctaataattgccatatttatttttttgccttccttttatttagagactagtaaacctatcccacaaacttctaaaagcatacagatgtgagaaaaactgaaactgaaatggtcattatttctaagtgcaggtttccttttcaactacagctgggttttgagcatatcttaattaacaaaaaaacttaaagaaagcttagcaaactttgaaggaggaggtcattgcattaatgttctttccaccattctcagcaatatcatttacacctgcttccctgaggtgttattccatatgccccttctggatataactatgtagggagtgtaagaatctttgcaaattgcttcaagagggtgatcatgattttaactgccactaccaatcaaatctgaaggtccatttatttaatgaacatgaattcatttaaaaaaggaaattaccaaactcatcatttaataacaaaaagggaaacaatacaaataaatagcataattaaatagcaaaaggcaatgagaatccaagcattttgagtatctgcaaaaggctaacaatgaattttacaaattaattgttgtaggacaggtttttttgtttgttcttttctcaggatggagtctcactctgtcgcctaggctggagtgcagtggcgcaatcttggctcactgcaacctccacctcccaggttcaatcgattctcctgcctcagcctcccaagtagctggggattacaggcacacaccaccatgactggctaatttttttttattattatttttagtaaagatgtggtttcactatgttggccaggcttgtctcgaactcctgacctcaagtgatcctcccacctcggcctcccaaagtgctgggattacaggcgtgaaccactgcacccggcctaggataggttttctcattgccattccattagagttttgaaaagaaatctattgaaaatctcattgaactatacacttatatcagtgatttttaaggcatataaattacacatcagtaaagtggctagaaaagttatataccaaaacttttttccaaccatatctctactctgcatcttcaactttgttcagtctatgccatagcactttctcctgtatccaccatgtattgcgttacccaaccttctgctgaacctaaatttcatcacatttttaaataagtaactctcctcttggaccttaggcttgagataaattttccacttttgagggatttttttctaaactataacttcatataatttcaccccttgatttttctatcctctcttcttgtctcctctcatgtcatctcctttcttctctttccttccttgcttcttttatcacttttatttctggctatatagtcaattcatttactcagaatgtcacccatcctaatgcatataaactgtgaaggactggcacttctctgaggctctgaggttactcttactttcgaatggaaattggagttcttaagcactttcttaaagctaaaattagtaggaatggctattcatttcgctcacgtgaaaagtgtcagaaatatcttggatcttattgaggttttatttctcactactagtacaagactatactccttgagtgtggagactgtcttttttttttttattttgagatggagtctcgctctgtcgcccaggctggagggcagtggctcgatctcggctcactgcaagctccgcctcccgggttcacaccattctcctgcctcagtctcccgagtagctgggactacaggcacctgccaccacgcccggctaattttttgtatttttagtagagacgggggtttctccttgttagccaggatggtctcgatctcctgacctcgtgatccgcccgcctcggcctcccaaagtgctgggattacaggcgtgagccaccgcgcccggccgccggagactgagtcttgttcatcttcatgtgcatctcccataattgaatgtctggcgcagtactcaaaaagtagtattcaccaaattttatgtacccaagagttccggagaagtttgttgcttttattattgcccttgttcactgaagcaatcgttccaaatgccaacatagggtcctacctacttcttattcagtaccgaaggtccacacctatgtggtatcaaatgatcattttgtaaataatatgatctctgtcactttactaaaaggataaataagctgaccacatatgtgagaaggaggagatggcaaaaagccaagactcttccttctgcttccttgctcccagactcttcaggaccttaccccataaattatcattttttttctcatctactgctaattgatccatcttctaagcaaacaatcatactccaaacactgcttttaaaaacaatctctccttaggtcctttccccaggatatagtcatttttctctttttgtagccctttttctcatctatcgttcgtcaacaatttatcatcaatatgatctatgctttatatccatcagcttcaatctagctttttcttctaccgctattatgacacttcttgtgaaacgagcacatatgacctcttaatcgttaaattatagagtttatacattgtttcttgtattttgtttacactgaataaatctatagaatttgtaataattgctaaacgggtgaaatcactgtagcaatttcagccttgcttattttcaatggcaagtaaacctcattctgcattgatggtgaattcgaatgcaaagatatttatttaccatctgcaattaaaaaaaaaaggtatgggggaaatacaatgaaaacaccaaacagtatttttatctaaaattactatagagtggtacaaacaaccatatatcataaactacattatgttgtgaaacagactgtgatgatggaaatcaagtgtatattagacagaagggttattctaactggaaggactgaggggtgaggtcagggctgctttaaatgttgttttccttatttttttccctgcctttatttttcttctttgagctattgttgtttgagtggttaataacacttctcagttcataggacattgtcatcaggggtctatgcaaggttctcttatattttatgaatttatttacttcccgtaacttcattctccactggagaaaattttatacagaagatcacataagacctggacctgcgtggatgaatagtaggatgtccacagaggaagtgaacggtgctccaaaaagagggaaaaggggaacagaggtaccaagaagtgatcgttgcttaagtctggggttagtggcagcatatatgtctggaaagattgttgcagcaagttgtaaaggtcttgatatcctgtgttaatacaattgcaacacaatgacgaattttgagcaaatgggttactggatctggctcatgtgagatcattctaacagaggtatagagaatctattttagaaactgggtcagaacaaagataactgagaaagaacatagaagaaactggactggggagattactttgaaggtggttcgttatctaaatcataatcacaattaagatttaaggtaacatttcccattgatacagaagtttaaaataagacagacgtctatatgcaattgatcttttcttccatactggtcctacagacctgatgttaaatgctttttaaagtgctcttgttatccctataaacattggagcttggtttccttgggaaatgtaagagcagagtttattagtctattcattcctagtactaaaatataatggatccagtggtagaatgaaagattcagtttccttaacttgccatatatcttttattacattagtgatgtgttttcctgatatttgtttccttgtaaactgtacttttctctctttctttgaattagttgctgtcaaggtgaatagctgaataatcttgcattaattattaatacttcttatgccaaagctaattaatggttttgcacgatttaaataaactacagtcttatataaagaaacagctactttctttagaaagctaacacatgtataaacatgtggtcataatttgaacatattaataatgtaagtttccaacacaatcatataaagagattagaaacaaggagatcctaagtcttctatgatggcattctattaaaatccaaattgaaatgtgtgaaaaaagtcacttaaatatatgtgcctataatctatctatctatctattatctatctaatctatctatctatctcttttcagccatctatctatttattttactgccttcattacctacaatttgtttgtgattctccagattcctttttttccatgttatatttatcaagagttttgattttggtcttggattttctgcgatttctttattattctacatttaattatttttataccccaacagttaatgtgataacctttttctattaatatccctttctccattcaagtatttatttttctctttcctctctggcatttctctgtgaaggaaccttgacagctttctatcgtggtgtctttatggtgatagcacagacaccctttgaagttaacatcttgttttctcctgaagatagtttctactccttctttattttctttgaccccagcccagacttcaataatgcattgaacttgctgtcgctgatagtccttctgctggtatttcattgctgtctctcttgctcagggtcagggacaaactctcagctattctcacaagattttaataggcttttactggcacttaacatttataaatagcaaacaacaaatgacacttctgttgcatgtgctacaaaataaggtttttgtacattgaagaacatatttcttaaataaaaaaattaaataatgtctctataactacataacagaaaataagaccaaaccataattatataaattaatattatttggaaactttttagaacatgttttatatttttatgagtacatgtaggcttggttatgctggagtaaaatatcaacaggaaaacaccagtgtcttaaagcaacagttacagccctagccaactgtccagggcagctgtcatctcagtttttggctcactagttcagactccgtgatcatcaagagaaaggtagagtgttcaggaggatccacaccagtagtgtaaggcattggcctaaaaaggaacaaagttactttctctgaaaagcccttaaccagaattgttcacaggtttttacctaagtgaaaagaaaaaatgaaaaagacacaaaagggtaattctcttaaatagctacagaagtaaataatcagatatggataaagactagaaatttctcccacaacatgatacaatagatttctattttactgccaacaacatattaattctactttactccgtggctacaaactttggaagatgttattagcaagcattagaagaagaaagagagataatttgttatggatgaggcattcaaatcttgataaatataaacaaagtatttgggactagaataaataatgcaaatacaaggtaaaataaaaaggatacatcagttagaggacagaaccattttgagagctttttggagatgagtgtggaaagaaaacagaaaaagtggcagagagggattgtatggaggttgtgaatggtgactattaaaaacactaaatgctgatatccacatatgctcatgtccaggcaagtccacagatggaaagatacttagctgtagcagaaataaggaatgggctgtgaggtttacaagaacagaccacccaacacctatgtgaaatgaaaacctggccaaggaccacagtcatgaattcaacttcattgtccagaaaactaactcatgcctcatagaaatattatggaagcatccattcctttttacataaagcccaattttaccgtatgcaaaaaatttacagagcatgcatatgcttgcaaataattcattttctgtgccctttattttactcataggttgaagaagtaaagaagtgtcacaaaggaaagatcttctgggtcctaacaggactaatatcagtgcccaaaatgaaaatgcattcttctgcatacctagttactgtttcggctggtgtttcttacttacagttaataaaatgttagacatccctctagttcacaggttagccaccccagctccccattcagagctccctagtgggaagctgttgagcctaaaattcatgattgtcagcctccaacagagaacttccacagattgctgctgctacagcttcaggatccaatccaagtcctgctttatgccagtctggtgtttaacacttagtctggtttattacttccaatcagtcctttttggggttatgttaactgaaattagtttctgttgtttgcaaccaaagaaccataattaagactgccctctccactccccacacagctgagatttttgcacccaagttgactaagaaactcctgaaaataaatagcaggtttaagatcctgttctagagagctgaatcacaagacatttaaaggagaataaacagggttcagttactaaattcctttactggagaaaatagtcaaaaagagaaaaagcaaacataactaaagagttttaaaatcgatgacatcagaagaatgtggtataatcaatagttacaggaagttagcctgtgaatgacttgtagacagtcaatggtattcacatatgcatacgcttccataaacctgttgttctttctcaactattccacatatggaaggggcatgtgactcctttccctctcctttattgattttcctcatggtcactattccaactgcactcagctagcggtagttgtcttaatatgtcataccctttaatgtgtatgtttttgtgcccaagttatttctccttccttggagtgacttttctcccttgtttgtctgtcacttcttagaatcagctgtcactctttgaaatctcagagtcaataacaagaacaactacaaaaatgatcactcactcactgctttctccctacagttcccagaacctactcctagtattccatttgtcaaaatgcagtttagtatttagttgcgtctgttatctttaatccactgtgacttcctaaaagtggggctgtgacttacttgtcattgcatatctgggaggtacttggtacttggcacagggtgaataatacttttttttttttccacacagatgaatgaataaattagtcatctagggttaagatttttccacctcaaaatctgacacatacacacctatttacaaaaccttatagaaccaagtttagataaaattaataaactgaaaactatcctgtccttttatatttaggttgtaaattcaatgtagataatggatggattcttattatgtgtgtgtgtgtgtgtatatatatatatatatatatatatatgaatttattttttaacagaagcatccaatgctttttacataaaacccaattttaccctatgcataaaatttacagagcgtgcatatgcttgcaaatacttcattttctgtgccctttattttactcataggttgtacgactatgtgcccatgtgcatgtatgtgtgtgtgtttttatacacatagatgtgtgcacacgagtctacatgtttgaatagattttgagaagcaattgtaatgcactattataattgaagtccaaattgactgcaactatgtcaatgagtgctgaatcaccagcctcactatttcctccttgaatagcctttccgtcatctccattttctcgagtaatgctccctaatcctacactgtaccttcactcccttcttgccttctttccattatgtttattcttcacggaactgacatcaactttattttcaaacagtgacttcgttttcaataaaccaagctagaaaacccaattctgtatgtattctgggcttggtttttttctgatgttaattcaccatattaagtttttgtcttggctctgcacaatctggtgattagcatatatgtataaaatagaaaagagcttttatatttaatgtacttttcatgcgcattgaaactctgggcagaagatgtggggtaaatgcaattactatgtagagtagcatggtaaatctcaaattacatgagaaatttacctagaattagatcagatacatagatgataggtaggtagatagataaattttatttaaaatgatcgtcatcaggagtgaatctccaaaacattgtgaagctgtagaacttatattgggtatttctttgattgcctgtgctcatccattcttccctttatgcaagcatccccctctggacctctcactcttcctcctcccacctaccctaatgggaattacccaccatgactgcaggccctccaggatgtggttcccaatttcctgtccctcagagtctcaactgccattctctagaccttgtccctgacacctatacttgacatactgtcatgtgctgtcctagagttctacttactcattatattcttttcaggtattttcttttcgcagggtcacactatgtgaaatgctcttatctcccctgggagcctgaaaaatgcagctttatcttgaaatctcagttcttctgagattacctgctccagaaagactcttccaactacacagtggttatttagatgaaattacctctattttctgccttatcaattctaatattgcacttgccatactgcatttatttctgcatagaatttttgtgtgagacaaaaggaaaaaatgcacccaattctcaagcactccctgtattctacaatgttccttcacggtgtctggccgttttgacgctgagcttgaccatgtgactcactttagccagtgggatgttagcaaacgtgaagtaagcaggggcttgaaatgagcttgtatattgaggcttctttgctcttgccttttgccattgccaggagaacctgcccagaggagcctgctggaggatgaaggacacgtggagcacagccatgtagcccttgtcatctcagccgtggccatcctggaccaaatgctcacctgcaatgtgttcattatacttgttgtggcaatgcataaccaatatggttgctttgcctgtattttgtgacctctttgtgagtgagacatctatgtcttgattaagtctctttcccccattcctagaacagtagttgatctattacattttggttgaattgaacctgttgaatgccgttattgttcctttctcagaaaaaaaaatgagtgctgtatcttatttctaacaggcttctaaacagtttagaacccctgcttaaaggaattctacaaaaaatattgagaactgcataacctctttagagtaatcaacatatgcaaataaccagtttatctacctctttagtgagccttaaactttgcaagagtataaaaaattatatattttttctcaatagtcttcatgtaattttctgcacttttctaaaattggttgtggaaattgtgcccggttttagagtggggggaaccagcaagtttggaaacatcatcagtgttcttgttttactcgtcttttagtaaacacattaggtctggacaaagtctaatgtatgtgcaagttcaacataaactgcatcgatcaattaagtaatctctccttttcatgtacttgataaagtactatttctcatatacatttttagaataaaaattacccataaatttgcaagatcggcaggtataaccagataaagacagttttcacttttgtataaataatgaaagtcatgcactcaagatagggactgtggaaagactaggaattctaggattcagcatatttgagaagattgctctggcccccctcatgaaggacttttcattcaagctttgaaagattcaatctatgcaaggatgtttctctaagctgctagtccaaaagtaataaacatcaagcttacggatgggtgtggaaactgaatggctttgcttttcttctgagggatttaatttatttttaatatcacaggtggcttgaggcgaggtgtaatcatctgtcactcttcagttaaatcatatcacctcacttctgaaatattctttgatctctctacctgtaaatcacgttctactttctctactatagactgtagcatatagatataataatgacatgacaaattaccaagagcatggagagtatgtctatttaaaagatgattgaaaaacacacacatgcaaatactaacccagacatttactttttaatgtttttcttcttttttgacttgttactagaatataaaattatatgaaacacatactgaagacaagttttaattttttttaatttaaaacacatcaggcatttcttttttactggctttatagtttaggcaatattaacaccttacatctgtaattttagcattttgaatacacagtttttaatgtacattatccattgggcagatccatagaacaagctaaaactttccagattcacattactttaaaaatattttgatttgctgggtgtggtggctcacgcctgtaatcccagcactttgggaggccgaggtgggcagatcacgaagtcaggagattgagaccatcctggctaacacagtgaaactccgtctctataaaaatacaaaaaattagctgggcgtggtggcgcacagctgtactcccagctactcgggagtctgaggcaggagaattgcttgaacccgggaggcggaggttgcaatgagccgagatcgtgccactgcgttctagcctggcgacagagcaagactccatctcaaaaaaaaaaaaaaaaaaaagatttgttgtcatatgtcttagttaacaaattttctgagggggtcattgggtaaagtatgcctcactagattatgttaggaaaagtgatgggacattaatttgtgttattccaatataaaaagggcctcttttcttcccccaatcaatctaactattaaatcacttataagaaacttaaatgtcacaataagataccaactgtcttgaataaaagtcatagatgcacgcctgtaattccaggactttaggaggtcgaggtgggtggatcacgaggtcaaaagatagagaccatcctggtcaacatggtgaaaccccgtctctactgaaaaaaaaaaaaaaaattagctgatcatggtggcatgcacctgtagtcccagctacttgggagtctgaggcagaaggattgcttgaacccaggaggcggaggttgcagtaagccgagactgtgccactgcactccaacttgagtacagagcgagactccgtctcaaaaaaaaagaaaaaaaaaaagaaaaaaattcatacatggaatgcctttcaaggaaacattaccttaaaaaagtgtaatattataataatcaaaatagccaaattcatataattttacaaaaaaacaagatttgctgaaacggtgaatcaaagaagtcattgtgaaaacagctttagctgcataaatgataaaatctagaaatagggatgagtgttattgaaaagaaggcttctgtttatatgaagaaggaagtctgaagagataagggaaagtgatatactggctgagtgtcctttatgcaaaacccttaggaccagaagtgtttaggatttaaaattttttagatcttagaatatttgtatgtacctaatgagatatcttaggaataggaccgtcatctaaagatgaaattcacatatgtttcctatacacttaatacacatagtttgagggtaactttatgcaatattttaaataattttgtgcatgaaacaaaattttggaaagcaaaggttccactgtctccacaaaccatgtggacagtctgtagttgattggcatcaccatgatttctcactctgaatttatacactattgataagcaatcatcttcttacacttatttgcacataagtacttaacagcaaaaaaatgtgacatggtattttcagcttattttctaataaatacttattagtcatataactgctatcctaatgtttatgttgttagatcaaaaaaatgaataagtatgttaaaggacctcggacttccaaaataaattggtgggcattattgatgttttatttctctgaagcctaccaactccatttcctgattcttcataggactttttgacatattgcttcaaactcttagatcaatgacatattaatccctagatttaaaagaattattgctatattaggcagtatgcatttagttgcaagtaataattttttaaaaggagctgatcaaaagggaatatttattataaggatacagtcatagtgggcagcaatatacttaggcctctggaatgacctgagagagaggactggacagaagtcttctctctgtccttgtgtttcttatctgaattcatttgattaatcagtatcttgatcaaaaataaacagcttactctaactgagtaatttgggcagaataaagagacatcttatacagacaaggtatagcacagctccctggcataaggaagaccaaggagtcatttccacatctaggtctggaggagaaggagcagaacagaaaacgcacagaggaaaactgcatgggaaggacaccagcaggttagcgctgcccctgtatctcagaactagcagcaggaatactccttaagatgccattttttggacctttcttccattgtctcatatctctttctaaccagagctgggaaaagttctccacttttcagggttcatatgatttgactgaacacacttagatgacccaagataatctctccatctcaatatcatgtattcctttgggttctgtaaaatgcaaattgtcctggaatacccaatgcttgaagcacttttttataaggtgtggtgcagttgtagtgtaagaatttaacccccatgagagcagagactgttttccttatcctttgttttgctgtatcttcaggatttagaatagtatttggcacataaaaggagcaaagtaaatattagttgactgaatgagtgagtgaatgagtggagagagcaatgccaagagagagatctgtagttttgagaagtaacatataggcaaagagagaggtttcatcaatacagcccctgccattatctctctcccggattacttccaagagtcccactgagtttttctgaattgcattaatctcaaatccattcctcattttaagactaaaatgggatttcttttgccatgtcgaattattcacttccttggttaaattccaactgaggtttccttttgcctgttgtataaaatcaagttcttacaacacccttgaagattggccccgagtacctttctcctcacattgtgctctgcagctgcattaaaaatgttctctttccttgctcacctcctgtcctttcttatcttgaggcctttgtcggtgctaattcctctactttgtatgccctgccatcttgagacacccttgtctgtcatctttgtttgttcttaatactaaacacaggtgctccaccctccacaaagcttcccttgacacttaaactccaagtttgctcctagaacctcctctgtatagttttctaccaccccagaagatgctgcatcttgttttttggctgtgtctcctatcaacttgatgtggggaaaagcaaagcaaaataaaacaaaactttattagtgccagaaaaaaagaatcatcaaaaggatcaccctttagaactatatattatacttcctgctaattcattccacttttccctgaggaaatgctatgtacacatgcatgtgtataaacccattgttatgttaattcaaccaattagtttttttttaatttatcagtctcctttttcctcatgaccatccctaaactcagaatcaaatttccagctcaattatatttaatctggtatatttcatggtctctacatttatggggttttttttctccatcttttctacacaagaaccaatctagtattgggccctcattttaattagatttttatcttgtttttaataattcctatatatgtgcttttttgtaaattttaaaatctaattcattaaactttaagttagtgctttttgaacacctaggattgccataaaaagaaacaaacacgcataaaaaattggggggacatagtttctagaaaggaaaattcttaccactgatattttttcttttccgggagtcaataactccagcaaataaatacttccaaaagaactgtgttctgtaatgtggaaatgaaaaacaaatctagttaattcattcagaagatttttctgtacctgtatttaggaataaatttgcatcttttacattggttccttttgtcattattgtaaatagccttggatggtaataacccactccattgctcataaaacccatttgatctgtgtttatcacttgctctataagtagctcttcatttctgtttgttgctatcatggttataaaatatactactataatagttcttaaacatacaatagcgctataaaacagtatctttggtgggtatttaagcaattttaatgctgagacaaaataatttaatttcctacccatatgttgaacgttccttaaggcactaaaaaaatctctaaaatccatatgcttgaaaatatctaaatttctgccaaacttagttcaggcttattagtaattcctaacgagtgaaatcattgtgattatacaagaaaaaattgattaaggtatggcagctttctctactatccactatttcagagctgaaaacaatacgtatatcagatcttggttctgtgacatctaaaagtatctacaacatttgtgagcaagaaaatgtagaacctatcaaataaactttgagaaccattaacttgttttactctacctgtaacactctctatagagctaaattaacattctttgtattgtcatttcaataaaaatgttatgactctttcatagttaaaatcaactttttaaattttcagtgctaaccattatcacttaataaacagcagttagattttgacaccttgatttattttaaagaaaagttaatatccattgagatgtgaattttacataaagagaataaacaaaatcagatgattatcttaatagatgcagataagccttgataaaattcaatatctcttcatgttaagagccctcaataaactaggaattgaaggaacatacttcaaaataataaaagccatctatgacaaacccacagccaacatcattctgaatgggcaaaagctggaagcattccgcttgagaaccacgagacaacaaaaacctctctcatcactactattcaacatagcactgaaagtccccgacagagcaatcaggcaagagaaagaaataaaaggtatccaaataggaagagaggaagtcagtctacccctgtttgcagacatgattctatagctaggaaacctcatggtctctgctcccaagctctttgctctgataaacaacttcaaaaaattttttaaatgtacaaaagtcaggtgcaattccaaacactagcaacatccaagctgagagccaagtcaagaatgcaatcctattcacaatcaccaccaaaagaataaatcatctaggaatacagctaaccagggaggcgaaagacctctacaacaagaattacaaaacactgctcaaagaaatcagagatgacacagacaaatggaaaaacattctatgctcatggataagaaaaaatcaatgtaattaaaatggctatactgcccaaagcaatttatggattcaatgctattcctaccaaactaacaatgacattcctcacagaattagacaaaactattttaaaattcatatggaaccaaaaaagcccaaatagccaaggcaatcctaagcaaaaggaacagagctggaggcatcatgtcacctgacttcaaactatactacaatggtatagtaatcaaaacagcacggtactggtaaaaacaaacaaacaaaaacagacacagagaccaatgcaacaaaacagatcacctacaaccatcagatcttagaaaaagctgacaaaaataagcaatggggaagggacaccatattcaataaatagggctgagataactgattagccatacggagtggtttgaaaatgaccgcttcctcataccatatataacaatcaattcaaaataaattaaaacttaaatgtaaaacctaaaactataaaacttctgaaagataacctaggaaatactattctggacataggacctggcaaagattttatgacagagtccaaaagcaattgcagcaaaaacaaaaattgataaatggcatctaattgaactaaagagctactgctcggcaaaataaactatcaataaacaaacaacctatacaatgggagaaaatatttacaaactatgcatccaacaaaggtttaatatctagaattcctaagaaacttaaacaaatgtacaagaaaaaaataaccccactaataagtgagcaaagaacatgaacagacacttaccaaaagaagacattcatgtggccaacaggaatattaaaaaatactcaatatcactaatcattacagaaatgcaaatcaatacgacaatgagataccatctcatgctagtcataatgatgactattaaaaagtcaaaaattaacagatgctggtgatattacagaggaaagggaatgcttatatactgctgatgggagtgtaaattagttcagccattgtggaaagcagtgtggtgattcctcaaagaacttaaaatgaaattatcatttgacccagcattctcattactgggtatatactcaaaggactacatattgttttatcataaaggaacatacatctgtatgttcattgcagcactattcacaatagcaaagacatgagctcaacctagattcccatcaacagtagactagataaagaaaatgtggtacacatacatatactatgtagctataaaaaaaaaaaaaaaacaatgaaatcatgtcctttgcagtgacatgggtgaaactggaggtcattatcccaggcaaacaaacaaaggaacaaaaaaccaaatactgcatgttctcacttatgggaactaataaatgagaacacatggacacaaagaggggaacaaaagagtctggggcctacttgcgggtgaaggctaggaggagggagaggaagagaaaaaataccttattgggtactatgctcattacatggatgatgaaataatatatacacgaaacccccatgacatgcagtttacctatagaacaaatttgcagatgcacccctaaatctaaaataaaagtccaaaaacgaccaaaaaaaaacaaacagaaaagaagtaaattttgtgaagtctttagtttataagttaaatatgctcaaaacataaagaaatcaagagttctagagtaattgtcatttatacaacatgaacaatgcaaacataaatttgaaagcttacataattctcaaaagaaccacaaattattgaaaaaataaacattttctatccatgtagatattgaccaaaatttttatagaaagagattaatgaataagcttaaattgtaaaagcaatctattgacatttccaaacctattgacttgatttattccagtactataacagtatataaaattatatattctatttataatagtacatgtaaatattacatacatagtattagtttactacataatgcatacagtattagtttattatgtaagcatatgtaactatacatatgtagttattagtttattcaccaattcaagtattcatcaaacttaacaaacatgtatttgcttacaacttactcaacatctgaaactgcacttcgtatcgaaggtataaaacttagcaaggtcagttttgcctgccagagctctcattcatatatgggagctaaatgagtggatctcatgaagattggtgatcaccagaggctggaaagggtagcatgaagggaaggtggttaatggtccaaacatacagtttgataaaagaaataagacgtggtgtttgatatattagcagggtgactatagtttacagtgatctataatacatttcaaaatagctagaagaaaataatttaaatgttattagcatatagaaaagacaaatatctagggggaggagccaagatggccgaataggaacagctccggtctacagctcccagcctgagcgacgcagaagacaggtgatttctgcatttccatctgaggtaccgggttcatctcactagggagtgccagacagtgggcacaggtcagtgggtgcgtgcaccgtgcgcgagccaaagcagggcgaggcattgcctcactcgggaagcgcaaggggtcagggagttccctttcctaatcaaagaaaggggtgatggacggcacctggaaaatcgggtcactcccaccctaatactgcacttttccgttgggcttaaaaaacggcgcaccatgagattatatcccgcacctggctcggagggtcctaccccatggagtctcactgattgctagcacagcagtctgagatcaaactgcaaggcggcagcgaggctgggggaggggcgcccaccattgcccaggcttgcttaggtaaacaaagcagccgggaagcttgaactgggtggagcccaccacagctcaaggaggcctgcctgcctgtgtaggctccacctctgggggcagggcacagacaaacaaaaagacagcagtaacctctgcagacttaaatgtccctgtctgacagctttgaagagagcagtggttctcccagtaggcagctggagatctgacaatgggcagactgcctcctcaagtgggtccctgacccctgacccccgagaagcctaactgggaggcaccctccagcaggggcacactgacacctcacactgcagggtactccaacagacctgcatctgagggtcctctctcttagaaggaaaactaacaaacagaaaggacatccacaccaaaaacccttctgtacatcaccatcatcaaaggccaaaatagataaaaccacaaagatggggaaaaaaccgaacagaaaaactggaaactctaaaaatcagagcgcctctcctcctccaaaggaacgcagctcctcaccagcaatggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagtaatggaagatgaaatgaatgaaatgaagcgagaaggaaagtttagagaaaaaagaataaaaagaaatgagcaaagcctccaagaaatatgggactatgtgaaaagaccaaatctgcgtctgattggtgtacctgaaagtgatggggagaatggaaccaagttggaaaacactctgcaggatattatccaggagaatttccccaatctagcaaggcaggccaacattcagattcaggaaatacagagaacgccacaaagataatcctcaagaagagcaactccaagacacataattgtcagattcaccaaagttgaaatgaaggaaaaaatgttaagggcagccagagagaaaggtcgggttaccctcaaagggaagcccatcagactaacagtggatctcttggcagaaaccctacaagccagaagagagtgggggccaatattcaacattcttaaagaaaagaattttcaatccagaatttcatatccaggcaaactaagtttcataagtgaaggagaaataaaatcctttacagacaagcaaatgctgagagattttgtcaccaccaggcctgccctaaaagagctcctgaaggaagcattaaacatggaaaggaacaaccggtaccagacactgcaaaatcatgtcaaaatgtaaagaccatcgagactaggaagaaactgcatcaactaacgagcaaaataaccagctagcatcataacaacaggatcaaattcacacataacactattaactttaaatgtaaatggactaaatgctccaattaaaagacacagactggcaaattagataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctaaaaagagacttagactcccacacattaataattggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcactacaccacacctattccaaaactgaccacatacttggaagtaaagctctcctcagcaaatgtaaaagaacagaaattataacaaactatctctcagaccacagtgcaatccaactagaactcaggattaagaatctcactcaaaacttctcaactacatggaaactgaacaacctactcctgaatgactactgggtacataacgaaatgaaggcatccttgatgaacattgatgcaaaaatcctcaataaaatactggcaaaccgaatccagcagcacatcaaaaagcttatccaccatgatcaagtgggcttcatccctgggatgcaagcctggttcaatatacgcaaatcaataaatctaatccagcatataaacagagccaaagacaaaaaccacatgattatctcaatagatgcagaaaaggcctttgacaaaattcaacaacctttcatgctaaaaactctcaataaattaagtattgatgggacatatatttcaaaataataagagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccgaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccagcttacaagggaggtgaaggacctcttcaaggagaactagaaaccgctgctcaaggaaataaaagaggatacaaacaaatggaagaacattccatgctgatggataggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaagtaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggacgtgaacagacacttctcaaaagaagacatttatgcagccaaaacacacaggaaaaaatgctcaccatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaaccatcattctcagtaaactatcccaagaacaaaaaaccaaacaccacatattctcactcatgggtgggaattgaacaatgagatcacatggacacaggaaggggaatatcacactgggttctgttgtggggtgggggttggtggggagggatagcattgggagatatacctaatgctagatgacgagttagtgggtgcagcacaccagcatggcccatgtatacgtatgttactaacctgcacaatgtgcacatgtaccctaaaacttaaagtataataataaaagaaaaaaaaaaaaagaaaagacaaatatttaaagtaatggatatcccttgggctaggggagggatagcattaggagaaatacctaatgtagatgacgggttgatgggtgcagcaaaccaccaaggtgtgtgtatacctatgtaacacacctgcacgttctgcacatgtatcctacaagttaaagtataattttaaaaaagtgatggatatcccaagttacactaatatgacctttatacattatatgactgtattcaattaccatgatgtacattcactactcattaatacaaatttttttaaagaaaataaaatagatatttaaaatgtggtatgataagtactgtaacagtggatggtagatcttccaaaacttactagttccttttcagtttggcatctacttcttcattttgttaaaataaaacataattgaatatttttgtgtttatcttaatgatattgtaatttacgatttttacaagtatgcaactttatgattttaataaaccttacttaaatattattgtagccaattaagtaaagctaatccagacatctatgcatcaagtttgttataggtggtgacacactgtaaaaatgtgtacacatttatgtaacaatggaattaagtttttaatttattcctgctggtggataataacaggaagtcagggagatggaggcacagttgctatctatccagtcacatattgtttgcgactaagcaccattcaagagaccttctttctgcctcattaaataagttaatcatgtaaatcacagataaaatttgagaatatatggatatagtttacacataaatgatgtatttttattgctgagaataaaaacagatgtgacaatgcccaggtgtcagtcacaaaatattatcattctttagtatctaatatgaatgaatggaaaattaaaaggtcaaattgagatatatatatgtatgtgtatatatatataatctgtagaacataatcaccaatacaaatcattctccataattaaaataagtctaagtagctcaactgctgtgataagaatttaaaatgagccacatatcatatctggaaatggcattgagagactttttaaacagaagctccaaaaatccatcattttatgaacaaaatgtctattaatataggtttagtgagttcatgactcatgtcatggctaaatcctttttatttttcacagtccctcagtactccacaaaccttctactgttgccagcagtattagtagtgtggccagacagaggatgcaacacctgaaagattgatgcagaacaactaaataaatggaaaggcaaacgtaaacatgatcatttcaaagcaaataattacagtcatgtctctggaggcaaatattggcgcaaatttgtcttttcaatcagtttaacatgctttaaaaaacttctctttcgattttgtttgatccatggttatttaggcatatcttatttagtttcaaatacttggggattttccacatatatggttactcatttggaagttaatcgtattgtggtcaaagaacatacactgcataattttaaatgttttagatttgttgagacttactttgtggcttagaatatggtctatcttggtaaacgctttgggtgcccttaaaaatagtgtgtaatctgctgttgtacagtggggtgttccagaaatgtcaattaggacaagtggattatgttgtcgtttacctcttttatatccttactgattttctctctgtcctgtcagtcattgagacatgaatcttgaaatctctaactgtaattgtggaattgtctgtttctcattgcaattctatcatttttgacccatgtatttttcttaatttttaggcacataagcatttatccttctgataaattgacccttttaacccatggtaatattgtttgctctgaaatctactttgtctaatattaagatagcccacacagctttttgttgttgttgttgtttaatgctggcatagtttgtatttttttttatttctttaattttaacatatttggggatagcagattaagatggcagataggagacaggactagccttgtagctcacgcttggaggaacagagcaggatgtggaggctcacatcctcaacttttgctccaagaactactgcaagaatgtaccaggaaagctaagagaatccacacaccctttgaaagaattggatcattgctgcaggctccctgagacactgaaaacctgtgagtctgcttgctttttcaatggggaggttcctggtctggggccaattctcagccctgctcactggttgcctggaaatagactcggtgctgctgtggggtcacggtgggagtgagaccagcctttaggactgcaggctgctgggagcagggtgaggcctgtgactgctggctttcccctacttccctggcaacctggatgagtaagcagaggcagccataatcaccctcggaatataactccattggactgagaaccacaccccgtcctccacatgagctgaatgaagcaagccccgcccaaggagagactgaattcagatatgcctatccctgcccctaccctgtggtctttatctaccagccctggtagctgaagacaaaggtcataatcccttgggagctgtatggccctgtctaccacctgaggaacctgaatactgaaccaggtgtccctagggcaagtttgcatcctgcgcacaggaccacagataatgggctcttgagagcaccacctcctggctggaggccgaccaacacaaaaccagcacattaaacaaaaacacaaccaaggaccctcacagattccacttcactcccctgctgcctccaccaaagcaggcgttggtatccacagctgcaagacctgaaggtggatcacatcacagggctctttgcagacatgccccagtaccagcctggagcccagtagctccgctgggtggctagaccaagaaaagcaaaaagtatcactatagtttggctcacaggaagctccattcctaggggaagagggagaacactacatcaagggagcaccctgtgggacagaagactgaacggcagcacttgaatcttagatcttctctctgacatagagaaggaaccagaaaatcaattctggtaacatgacaaaacaaagttcttcaaaacctccaaaagatcatgccagctcaccagcaatagatccaaagcaagacaaaatttctgaattgccagaaaaagaattcaggtcaattattaaggtaatcaaagaggcaccagagaaaggcaaaatcaaacttaaatcaaaaacatgatataggatatgaaaggaaagtaattcatccaacttgccagtctttgtcttttaattgggtcatttagcctgtttacatttaaggttaatactgttaagtgtgaatttgatcctgtcgttatgatgctgcctggttattttgcccattagttgacgcagtttcttcatagtgtcgatggtctttacagttggtatgtttttacagtggctgatagtggtttttcctttccatatttagtgcttccttcaggagctcttgtaaggcaggcctggtggtgacaaaatctctcaccgtttgtttttctgtaaaggattttatttttcctttgcttatgaagcttagtttggctagatatgaaattctgggctgaaaattcttttctttaagaatgttgaatattggcccccactcttttctggcttgtagggtttctgcagagatatccactgtagtctgatgggcttccatttgtgggtaacccagcctttctctctggttgcccgtaacattttttccttcatttcaaccttggtgaatctgatggttatgtgtcttggggttactcttctcaaagagcatctttgtggcattctctgtatttcctgaatttgaatgttggcctgtcttgctaagagtcaaacacatcggtgggctgtatttaggagactcatctcatgtgcaaaacacacataggctcaaaataaagggatggaggaatatttaccaagcaaatggaaagcaaaaaaaaaaaaaaaaaaaagtacaggggttgcaattctagtctctgataaaacagactttaaaccaacaaagatcaaacaaaggctaagaagggtattacataatggatcgatgcaagcaacaagaaaagctaactatcctaaatatatatacaccccatactggagcacccaaattcatcaagaaagttcttagagacctacaaagagacttagacccccatgtaataatagtgggagactttaacagcccactatcaattttagacagatcaatgagacagaaaattaacaagcatattcaggacttgaactcagctctggaccaagcagacctagtagacatctacagaactctctaccccaaatcaacagaatatacattcttctgagcaccacatcacacctattctaaaattgaccacataattggaagtaaaacattcctcagcaaatgcagaagaatggaaatcataacaaacagtctctcacaccgcagtgcaatcaaattagaactcgagattaagaaactcactcaaaaccgcacaactacatggaaactgaacaacatgctcctgaatgactactgggtaattaacgaaattaaggcagaaataagtaagttctttgaaaccaatgagaacaaagacacaatatagcagaatctctgggacaaagctaaaacatagtttagagggaaatttacagctctaaatacccacaggagaaagcgggaaagatctaaaactgacaccctaacatgataattaaaagaactagagagacaagagcaaacaaattcaaaactagcagaagacaagaaatcactaagatcagagcagaactgaaggagattagagacacgaaaaacccttcaaaaaaccaatgaatccaggagctggtttttataaaagatcaacaaaatagaccagtagccagactaataaagaataaaagagagaagaatgaaatagacacaataaaaaatgataaagggcatatcaccactgatcccaaagaaatacaaactaccatcagataatattataaacacctctatgcaaataaactagaaaatctagaagaaatggataaattcctggacatatacaccctcccaagatgaaaacaggaagaagtcgaatccctgaatagaccaataacaagttctgaaattgaggcaataattaatagcctaccaaccaaaaaaaaaaaaaaaaagcatgggatgagacagattcacagccaaattctaccagaggtacaaagaggagctggtaccattctttctgaaactcttccaatcaatagaaaaagagggaatcggccctaactcattttatgaggccagcatcatcctgataccaaaaactagcagagaaacaacaaaaaaagaaaatttcaggccaatattcctgatgaacatcgatgcgaaaatccttaataaaatactggcaaaccaaatccagcagcacatcaaaaatcttatccaccacgatcaagttggctgcatccctgggatgcaaggctgattcaacatatgcaaatcagtaaacgtaacccattacataaacagaaccaatgacaaaaaccacatgattatttcaatagatgcagaaaaggccttcgataaaattcaacagctcttcatgctaaaaattctcaataaactaggtattgatggaacatactcaaaataataagagctctttatgacaaacccacagcctatatcatactgaatgggcaaaggctggaagcattccctttgaaaaccaacacaagacaaggatgacctctctcactactcctattcaacatagtactggaagttctggccagggcaatcaggccagaaaaagaaataaagtgtattcaaataggaagagaggaggtcaaattttctctatttgcagataacttgattgtatatttagaaaaccccatcatctcagcccaaaatctccttaggctgataagcaacttcagcagtctcaaaatacaaaatcaacatgcaaaattcacaaacaatcctatacaccaataatagacatacagagagccatatcacgagtgaactccaattcacaattgctacaaagagaataaaatacctaggaatccaacttataagggatgtgaaggacctcttcaaagaaaactacaaaccattgctcaaggaaataagagaggacaaaaacaaatggaacaacattccatgctcatggataggaagggccaatattgtgaacatggccatactgcccaaagtaatttatagattcaatgttattcccatcaagctaccattgacttatttcatagaattagaaaaaactactcaaaatttcatatggaaccaaaaaagagcccatatagccaagacaatcctaagcaaaaagaacaaggctggaagcatcacgcttcctgacttcaaactatactacaaggctaaagtaaccaaaacagcatgggattggtaccaaaacagatatatagaccaatggaacagaacagaacagaggcctcagaaataatgccacatatctacaaccatctgatctttgaccagcctgacgaaaacaagcaatggggaaaggattccctatttaataaatggtttttggaaaactggctagccatatgcagaagactgaaactggaacccttccttacacctcatacataaattaactcaagatggaataaagactaaacataagacctaaaaccatgaaaaccctagaagaaaacctaggcaataccattcaggatataggcatgggcgaagacttcatgacaaaaacaccaaaagcaatgacaacaaaagccaaaattgacaaatgggagctaactaaactaaagagcttctgtacagcaaaagaaactatcatcagagtgaacaggcaacctacagaatgggggaaaatttttgcaatatactcatctgacaaagggctaatatccagaatcttcaaggaactcaaacaaatttacaagaaaaaaaaaacaacccatcaacaagtgggcaaaggatatgaacagacatttctcaaaagaagacatttatgcagccaacagacacacgaaaaaatgcatgtatgtttattgcggcactattcacgatggcaaagacttggaaccaacccaaatgtccaacaatgatagactggattaagaaaatgtggcacatatacaccatggaatactatgcagccatagaaaatgatgagttcatgtcctttgtagggacatggatgaaattggaaattatcattctcagtaaactatcgcaaggacagaaaaccaaacaccgcatgttctcactcataggtaggaattgaacaatgagaacacatgaacacaggaaggggaacatcacactctggggactgttgtggagtggggggaggggggagggacagcattaggagatatacctaatgctaaatgatgagttaatgggtgcagcacaccagcatggcacatgtatacatacgtaactaacctgcacattgtgcacatgtaccctaaaacttcaagtataataataataaaatttaaaaaaattaaaaaaaaagaaagaaaaaaaaatgctcatcatcactggccatcagagaaatgcaaatcaaaaccaaaatgagataccatctcatcccagttagaatagcaatcattaaaaacgtgggaaacaacaggtcctggagaggatgtggagaaataggaacacttttacactgttggtgggactgtaaattggttcaaccactgtggaagaaagtgtggcaattcctcagggatctagaactagaaataccatttgacccagccattccattactggttatatacccaaaggattataaatcatgctgctataaagacacatgcatgcatatgtttattgcggcactattcacaatagcaaagacctggaaccaacgcaaacgtccaacagtgatagactagattgagaaaatgtggcatatatacaccatggaatactatgcagccataaaaaaatgatgagttcatgtccttcatagggacatggatgaagctggaaaccatcattctcagcaaactatcgcaaggacaaaaagccaaacatcgcatgttctcactcatagctggaaattgaacaatgagaacacttggacacaggtagggggacatcacacacagggcctgttgtggggtggggggagtggggagggatagcattaggagatatacctaatgtaaatgacgagttaataggtgcagcacaccaacatggcacatgtatacatatataacaaacctgcacgttgcgcacatgtacgctagaacttaaagtataataataaaaaaaaaaagagaaaaacaaccccatctaaaagtgggcaaaggatatgaacaggcacttctcaaaagaagacatttatgcggccaacaaacatgaaaaaaagctcatcatcactgttcattagagaaatgcaaatgaaaaccacaatgagataccatctcacaccagttagaatggcgatcattaaaaagttagggaacaacagatgctggagaggatgtggagaaatagtaatgcttttacactgctggtaggagtgtaaattagttcaaccaatgtggaagacagtgtggtgattcctccaggatctagaacaagaaataccatttgacccagcaatcccattactgggtatatacccaaaggattataaatcattctactataaagacatatgcacacatatgtttattgtggcattattcacaatagcagacttggaaccaacccaaatgtccatcaatgatagaatggataaagaaaatgtgacacatatacatcatggaatactatgcagctataaaaagaatgagtgaaaaaatatgtcctttgcagggacatggatgaaactggaaaccgtcattctcagcaaactaacacaggaacagaaagccaaacaccacatgttctcactcataagtaggagctgaacaacaagaacacacggacacagggagaggaacatcacacactagagcctgttgggggtgtaaggggctaggggagggatagcattaggagaaatacctaatgtagatgatggactgatgggtgcagcaaaccaccatggcaagtgtatacctatgcaacaaacctgcgcattctgcacgtgtatcccagaacttaaagtatgataaaaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggatgcttgaaaaatcactggaattgtgtatcaatcttaaactacattttgtctcctagagcagagtttacttatggttattcatttttcaattatgagactcgatttgtcatgtaaggagtgattttcttttttcccaacttttattttaagttcggggtatgtgtacagaatgtgtacgtttgttagttaaatgtgtgccatggtggtttgctgcatagatcatccgatcacctaggtattaagcccaggattcattagctatttttcctgattctttctctcctcccactcctcaccttcaaacaggccccaatgtgtgttgttccccaccatgtgtccatgtgttctcatcattcagttcccacttataagtgagaacatgcagtatttggttttctgttcctgcatcagtttgcatgctggtgaggttgtggagaaaaaggaatgctttgacactgttggtgggagtgtaaattagttcaaaaattggggaaaacagtgtggcagttcctcaaagtgaagacctagaggcagaaatactatttgacccattactgggtatatacccatagaatgtaaggaattattttctaatggttaatctgattactattttaggatgtagccacacaattctgggaatttcatttttattgaaaaccttttgacatgtagtccctaaactggaagttccttttgcacaaagaatttgacacccttctcagacatttttttcttgagagctgtctaagcaccatgcaagaggcttattatatactcaaaagtcacaatatgcctcataattttttttcctcaggaaaaatatttttcaaggtatcagtcttagaagagtcattcagggagaatgatttcctctgtcaattcaatgtatattgaaaagaaaaaaaagagtgtgatataacttgagaagacacaaagtgtaggcaacatttatgtggcaacatggcactgactattcaatctttattgatagctaatgagttttaccggatgtctacttggcttatcatagattattagagttggcttggtttattgtgtccaatcaggatggatttgcaatctaattaatttgttcctcacccctgttgaccttcaagggaataaacagaaggaaattcctagatcattgaatcactgctttcaccactacagagtcattcttctgcatgcagattgaatattaaaaaataaacagcttcacaggtgtttatttagggtgctgtgaaagaaaccaagagaagagctaaggaatttttctgtttatccttttctccaataatttcatggacaggtaaatctttaaaacacctctcaaaaacaccttaatttttttttaaaataatgtgacgaagcagcttttagttatttagcatttctaatcttgcaatctgacttagtggaaaatcactttgttttcttcatctcaggtttcaaaccaaaaatatagccataatgtgttctgcttttgtatagactgcataagataatatttataaaaatcactgtgaaacacagaccactcatcctatatataatatactacgacaataataggtgttgttgctgaattattctattttcaatgtttactatgatggttgaacacaaagcttgagcctattacgtataatttttttataaaatactctaaaagaagaatcaatacatgagaaaaaaattaaactttgacttcaacatagtctgtatggcagtgaggataaaatggctaaaagaaaaaacaagcaatatttgctaacaatagaagaaaatatcctggaatccattttttttcctagcaatagagggtaactctagaagttttttttttcttaccaaaatgccaagaatatacagcagagcaaaaagcatgcaaagcacagaagctgctttcagagtatgtcacagcagctgcattttgaaaagagttgaagaagtaaaaaacctgaaattttagtattacccatctctatatagttatgagttaatcataattctcttaagactgtaacttgaactattatacagagagatttaaaagtctttgaaaataaatatttgcgaacagtgtgattcagaatacaaagaaagatatttattttcctttagcaataatcaactgagtgttaatagtccttggagaggcagaacatttacaaattccttcatagaatattttaaaaataataaaagcaagttccatctacacttagaatataggttcattggccgggtgtggtggctcactcctgtaatcccagcactttgggaggccgaggtgggtggatcacctgaggtcaggagtttgagaccagcctggccaacatggcgaaacccggtatctactgaaaaaaaaaacaaaaattagctgagtgcagtggcaggcgcctgtaatcccagctactcgggaggctgaggcaggaggatcacttaaacacgggaggcagaggttgcaatgagctgagatcgcgccattgtactccagcctgggagacagagcaagactccgtcaaaaaaaaaaaaaaaagaagaagaagaagaagaagaatataggttcattgttaggtagactttataaacgttttttatccctttgctctctgttttaatcataagaattagtgatcctactcctttccacagtgactccttgcacttctctcttgaatataacagtcagtccttgcagggcacttacccagcagtcaggtgatctgttcttcacgagttttatttcacttgaacctctcaataacactgaggtattgatagtactattatctccccatttggcagacttgacactgaggccaacagaggctaagtaatgacttggttcatgcagttgaatagtgggagagtgaggattaaaccacaaaccctgtggttataaacacgatgagataacgctttgttatataaaccgagcctctcactctgtgacctttctcagaccctactccatccataattgttctctccactctcctgaccttctgtcactctctgtccctttgctttctccatctttagtggctccttttgctcagccatatattaaagcttttatgtttttcaaaactgcagtaataccatcgttcttaccctccagctccaactccttcctctgtgccaaggtcctcacagcaatggtcacttggcctccatttccactcttctcatttattttatctcacccaccatgaaactgaaagtgtactcttaaaatagagtaataaatttctgatttctagttttatttcagttcacattctactctaattgtatacaaaatttggcaatttttaccgcaatatcttccctccttttttttttttttatttttagagatacggtgttgttctattgcccagactgtagtgcaatggctcaatcatagctctctgcagcctcaaactcctgggctgaagggatcctcccacctcaactttccaaagtgctgagactacatgcgtgagccactgtgcctgtccaatatctttctttttctttttctttttctttttttttttttttttttttttgagacggagtcttgctctgtcaccaggctgtagtgcagtggtgcaatcttggcttactgaaacctctgtctcccaggttcaaggaattcttctgcctcagcctccagaatagctgggactacaggcatgtaccaccaagcccagctaatttttgtattttaatagagacggggtttcaccatgttggccaggatggtcttgatcttttgacctcgtgatctgcctgcctcagcctcccagagtgctgggattacaggtgtgagccactgctcccggcctggccaatatctttctctaaagtctcttcttcctttcctttttactcctgattttctttctatgtcagttcatttatttttattttttgtcctctctctccccttaagtgtttatgttttaagatttctgaccttttttctctcttctctccttgatctatcaagaatcattaatccacaaacaagaagagtcctaaatttctatctctagccctgactctcacctcagcatgggattcgtattacaaacagtacagtggacatcagcacctaaatgctatgtgggcttctcaaatatttccaaaaccaaacacatgatctcccactgccctcagaaatgtccctttcttcttcattttctatgtatatgagaatgaccattcagttatctaagcataaaactcaagacccttctcagttagttaaaatatttaaagtgtttagaaaagaccctgcacattataaacactcaataattcttagttaacactaaaattgcctttactagttaacagtactatttgccattgacttctcactcttcctcacttactatatccaactgaactcccgtcatgacaattcaatccctactaagtctctggacttttgatttctccttcctttttcactgccactgctttagttctttcaggctgtccattttcaaacaccagagctggtctccctgacttcagattctaaccattcccattacattttctcactgcctacagagttatcttgctaaaactcaagtggggtcaggcactctctgtgataagttcatgtaattgtaccacgtaaggcctttcccaatctaaacacaagctaccctgccagtcatgccacttggcatttagccgatgacaccttccatgctgtgctccagttagaactgcttctcaaccctaagactgaccatgccccgacatattatactctttttatacctatgctctatgccttctctttctgcctggaaaactcctacttcaatcttaaatcctattaaaacttttaactgttaatcttgattttaaacattactctttccctacctagctccctgtacacttccatccctaccccagtcaggcagaacagggtactgtctcctcagggtttctattttgtaaatttgtagaagcccatttttataacacaaaatcttaaataattgtttccacaatatcatatttttacaatattatgtttattgtccagtaattatgtaatagctaatcataactccaacgtatcttgaaggaggagcttcaggtttgtttatatttttattttcagaacgattcttatatttgacacacaacaaattcctaaaaactgcttgtaaagtgaatgaagtaaaacaattcttacatttcactttctcagccaacctactctttgattataattatggtagatactgcttttataacccacttcattcctcacatcctttacatttataccccaaatataaattggtaggaattctctaaaccattcagtgtctcattttccttacctgtaaaatgctgaaactactttataaggttgtcatgggatttataccatttatatacaaaaaacaattagaatataacaggtatctgattagcatctaatacaattaactattactatgattactcttgtattcgaatgttcctttttcctctgatacatttgtgtgcaatgctccctatgtttggatgataatgttttcttagttttcccacataaaagggagagatcagtgaatccctttataagataaaagacatatgtaattatattagtctattctcacagtgctataaagaaatacctgagactgggtaatttataaaggagagaggtttaattgacccacagttctgcatggctgggaggcctcaggagacttacaatcatggcagaaggcaaaggagaagcaggcaccttcctcacagggtggcaggacagagtaagtgcaaagagaggaaatgccagacccttgtaaaatcatcagatctcatgagactcactcactatcacgaggacagcatgggcaaaactgccccatgatccaattacctccgccttgtcctgtccttgacgtgtggggattatggggattacaattcaaggtgagattttgggtggggtcacagccaaaccgtatcaataattaagccctaaaatgctctttggttagaaatgatgagatttgttcttagggtagtaagaattattcttatgttattattttgttattataagagcaagaatttttagtccaattattacagtctccttttaaacaaacactttataagtggcttttgattatcgcaccattgtaaagggataccaaaggaaacctgaggataaggagtgagatgcttgctcttattttcacactggcagctaaacagacaaactactttctgctttttaagtgctcgccagttaaagctgcatgtgagcactattggtttttatttgtttgtttgttttacttcactgtttttttcaaagtactttatgctcattaacctattttctatgtggatattccaattaaatattagaacaaaaagttgtttacttttaagtttcttttaggagaatgaaagaaactcccaaatttctgcattagaatcgaattaaaatatagaaaagaaatttatctgtgagttcccccagctctgcaagatacgaatcatctctcatcactcactttttcaggcctcaggatcaaactagtgccagaggaggaccaggtgactttttttctgagggagagaagtaatgggagccattgtcattcctctcactttttaaatggattgagctgccatgggagctatttgtcaacaaaaacagaccagaactcattagttaaatacagatcatgtgagattcagggagcagcatatggaggggtataatgacaaacttaaaaacagccatttggttacaaattgtcttaatattaatagttacattctaccatttagttactacttcctaaatactgctatttacccataatacgtaataaaaaactaaaagatcgtgaaaggaggagagaaacaacgaatatactaaagttgttatggaaaatcttcgtagacttacagatattacacacatatgcatgtggcaaaaatactttttttcctttctgtccacattgtttcaaaactttcaggtgaatttttaattcattcattcatatttttttcttctatttacaaaacaaacatacattttgcagccattaagttccagggcctccggcaggcaaaagaaactaaaggccaataaaattgtcctcgagaagcttgtatttcttatgcagtgattttcaaagcatgttccttagagcaactacatgagacgtaccatgggaatttgttaataatgcaggcacctggattgactccaaattataatttccgtgcatgagcttccaaagtctttatgtttaacaagcaacctagttaattcttttgcttttaaaaaatttgcacactgatctaactgctttgctccactaagtgtggtctgagaaaggacaacggtatctacatttctcattccaattatatccaaattagagtcttttaacttgtcatccagtggttcacatgtacttcaaagtctaaagagtaataatctagtctatatgatttctggagccaaccatataatgatattatgtggaatggttggtgtgtgctgtgggagacacacctaaaaagttctccagaacttgaatcctaccatcacatattattctatttttaacatttctcaggtgaatctgtttcaactactatattttacttgggtttcttatttttgtttgtttatttctattggcactgaaaatttaagggatagtgatatgtagtttaagatgggttatcgtctggatatttgcctggtggaggggcatatgaacaatgaatatgaattgatacaaatacaccacaagtcagagttagcacaacatatcttcattcatccacttctttattttactcagcaaatatttatttatttattattttatttatttatttatttatttattttttgagatggagtctcgctctgttgcccaggctggagtgcagtggcgccatcttggctcattgcaagctccgcctcccgggttcacgccattctcctgcctcagcctccagagtagctgggactacaggcgcccgccaccacgcccggctaatgttttttttaacagatttttggtagagaaggggtttcaacgtgttagccagtatggtctctatctcctgacctcgtgatccgcccacctctacctcccaaagtgctggaattacaagcatgagccactgcacccagcctcagcacatatttattaggcttcttctttgagccagggatttagatagtatttaaaataataataaaagcaaatatttactaaccacttttactacgtattgatgagtctccttaattgtcacataagttactgcatttaactgtcacaaccctgtaatggagggacagtgattactctcgctttacaagtaaggaagctgaagcccagagaggtagaataacttgctcagagtcaccgagctagaatggattttattgggaacttaaatacgtatctctttcatcagagcccttccttttaacctctatgctatcctaatgctcagatttctgggactcagatcaccgaagcccttaatcaaacaaacctgtgaaaaatttatggtgaaaatattacatatgaggcaaacaggagggtcaatggaagtatggaaggaagcaagaattcacgaggagacagagaaggccagaagatgcttccagggcacatggacagagaaggacagtggtatcctagccttatggagcagaatgcacaacggcagaaagcatgagagaacacactgggtgtagggaacttaacatttcttggttttgctggagggtgagttttgagacaggggagaaattggaaatgatggacagaaagtaaaggatcagatattgaagagaatgatatgtcctgctaagtatctgacatttctcttataggtgatacaagtctattgaataattttgaactgataaattattatattttgcttcagataaattaattgtcaaacatagtgaaatcttttaaataacaataactccaaatggtttgttactgcaaattgtagtcttctgagggaacatataaaagaaacagctgtgtttctgagagagtttgtaggcattctgaccccaaggaaagggtaagcatgacatgttttcttataccagaggtcaagaccttcccagtggtttgtttttgacctggaaaattttgtgtgcacatttttttccctcagtcagtgacattattcttgcagagcaggtgcattcgaaaaattattttgtgttaatcttttataagcatgaatgatttttaagccatcatttaaaaaattattcctaggttttttggtagttttgggttctaaagactgcatattgttaggcacaataattaattgtgacgcactctacccacaaagaaatgtatacacccatcagcaagtctccattgggccatcaagtcgtctgcctgcctcagcctcccaaagtgctgggattacaggggtgaaacaccacacccagcagcctcaggaaactttcagtcacggcagaaggcgacaggagagcaagctcaccttacatggcccatacaggaggaagactaagggaaaaaaatgtgcacacaaaattttccaggtcaaaaacaaaccactgggaaggtcttgaccgctagtataagaagtaattttactagaagtaatgctttaataacaacaccaactccaagtactcaacaacatgatacttataaacctttacctgattaagccatccaattagccgttcaaagactgtgtaaatacagacatagatgatgtctgggggattacaatttgacatgagatttgggcagggacacaggtccaaaccatatcaccaggtgatcacagaaaaccaaaaaagagtaggaatatttaatgtagacatggtcatctgtgggtaaagtccttcttcatatcctatttatttaaccctcctcagagttagcagggttagtcacacactcatatgtacctttttctagaaaaaaataaatatttctaaaagtttgaattaagtgaactaaattatagttgactaatttttaaaaatagagtaaacagtcacaatttggagcacaaaccaagaggaaagaagaaggactttacccacagctgaccatgtctgcattaaacattcctactcttttttggttttctgtgatcacctggtgatatggtttgggcctgtatccctgcccaaatctcatgtcaaattgtaatccccagcattggaggtggggcctggtgggaggtgactggatcttgggggtggatttccccctcagtgttgctcttgtaacagtgagtgtgtgccgtgagatttggttgtttaaaagtgtgtaacacctctcccctcactctcttcctcctgtatgggccatgtaagatgagcttgctctcctgtcgccttctgccatgattgaaagtttcctgaggctgccgggtgtggtgtttcacccctgtaatcccagcactttgggaggctgaggcaggcagatgacttgaggtcacaagtttgagaccagcctggccaacatgatgaagctccgtctctactaaaaatacaaaaattagccgggcattgtggtgggtgcctgtcatcccagctactcaggaggctgaggcaggagaatcacttgaacccgggaagcagaggttgcagtgagccgagatcaggccactgcactccagcctgggcgacagagcctagctcaaaacaaaaaaaaaaaaaaaaaaaaagttttcctgagttctccccagccatgcttcctgtacatcctgcagaaccatgagccaatcaaatctcttttctttataaattacccagtctcgggtatgtctttatagcaatgccagaatgaactaatacacctggcgaatggaattaagttacacgatgatgcaatttaactaaatttcaagggatacgaaccctgctcacattgatacgatttctggtatctactacttgtagcatatgaaacaaataatcattggcttcttactctgtggttagcctggcattaacccaggagaggagggttctttgtcattctccctaactatgagatattgcttatgaggtagcataaagcagagatctccagcttagtgattttttttatgacccaaatcaggataccaacttaagcatttcagctcttatgcattaacaatctgtattctatgtacatttttcatagtaacagcaattttgtggtgtttccttattcttcccttttgtatcacagtggagcccattcactctgtttttccacacagtatatctttctaggtcacacccttgctgcctcaagaattttaacaagagttataaatctgcagtgtccagatacctggaaatctcttgctgaccttatccttcatcattttagcatgagaatttggtatgactttgagtaatgttgtgatttaagaaagcatattacagaaataggtggtgccctttgtaacacaacaaaaatgccatgagcccacaggtcctctgtcaataggccattctgttggttgttggttttccagctgtagagatgtcattaagatgcttctacttccttttctcaaattaaactgtttttctatcttatcttttttttttttttttttttttgcaataagtaacctgtgttttattggaaagaacataggaaatcaataaaatttaggtttgaattcaagctttggcacctacctgctaagtgattctcggattcccaatctgtaaaatggataaaacaaagccagtttcaaaagattgctatacattttaaattatgcaatacaagtaaaatgctaacattttatctgccatagagttggtcctcataaatatctagtgtcattgctattgtaattattttttttttgacagggcctcactgtgttgcccaggctagggtgcagtggtgtgatcttggctcactgcaacttctgcctcacgggttcaagtgagtttcgtgccacagcctcccaagtagttggggtttcaggcacccaccaccactgctggctattttttgtattttgagtaaagacaggttttgccatgttggcgaggctgatctcaaacttctggcctcaagtgctccacccgcctcagcctcccaaattgctgggattacaggcgtgagccaccacacttggcctaatattttgaacacattttactcttggctattgatgcacggagtgttagagctgaaatagttcttaattttggtctctcctactgtagatcaggaaggcaagagatagagaggacaaatgagctattcaaagagcagagggtcacaaatagaactagcgttctcctcaagccatcttgatccatcagtttcaattcatgctataatctattgtatagtatctgctctatgttgatatttccttactggtagcagtattcctcttcccacctcatagtgtatacttgtatatcattttgaagttgcagctaataatcaaggactctgtctaatgtttcatgtgaaacccttggacttcatgatattttgaatgttaaataatttcatcattttaatagtttatctcagcaatggcgtatgcaaaattagctggatgaagagtgttatctgaccaaggccaaaatctgtagcccagagacatagtacattttccctggcccagtggtgctggaatatatttaagcctttacagcaaactaaaacaattcatttaaggaattatgagagccaaactatttttttagagcctctgactgatacttcatgtgctaatagagaaaaatattatgatgtcaatgtttttctctttaaaatataatgtaatgtggcatgactgatatagccaatcttgaatattagaaatgatgcatcatcacctaattcatcaaaatcaatctcgaaaaggtcagtcttacttgaaaaataagttgattggccttaaatgaacatactacgatctcaaaattagagagagacctcatggttttgctaagttgttttttcaaagtaccctcatcacaaaatttaggcatgcaaatgtcaacaatttgtgtagttacgcatttaaaaagtcttcttcaatggaaacacacaaagtttcataactttcagtggctgatgcctaccgtaaataactaccacagattacatagtaaactcttcattactcagggattgaccagtcagttggtaaattaactgcgttctagattttttaattctctctcctcattgcatgtctgctggttacatcagtactcactagcaagtcaaacatcatgaaggaaaaaagctaaagaatatcccattgattttaaaaattatggagaaaacgtttaaaaattggctttcatttgaaactttgagtctctgtacacataatatatcaaagctccttctctttactatttatacaaggcactgtcttgcggtcagttatatattttaacaggtgaagagcagaggcagtaattttttaaaaaatttttctaatttttaatttgtataggtatatagtaggtatatatatttatggggtacatgagatattttgatacaggcatgcaatgtgtaatcatcacatcagggtaaatgagataatcattgcctcaagtatttatcctttctttgtgttacagacattcaattatactcttttagttatttttaaatgtatactacatttttgttgactgtaatcactctgtgtattaggccgtcctcacactgctataaacaaatacctgagactgagtaatttataaataaaagagctgtaattgactcacgcttctgcaggctgtacaggaagcatagcatcttctggggaggtctcaggaaacttacaatcattgtagaaggtgaaggggaagtaagatgcctcacatggccagagaaggagaaacagagagagaagggagaggtgccacacacttttaaaagaccagatctttttttttaattttattattattatactttaagttttagggtacatgtgcacaatgtgcgggtttgttacatatgtatacatgtgccatgttggtgtgctgcacccactaactcgtcatttaacattaggtatatcacctaatgctaaccagatcttacaagagctctatcatgagaaaagcactggaaggatggtgctaaacaattagaaactgcccccatgattcaatcacctcccacctggtgccccacctccagcattggggattacatttcaacatgagattttggggagaacacagatccaaaccatatcaacctgttatactatcaaatattagatcttattcattctatctaattatatttaggtactcgttaaccattctcagtttcccctgcatctctcactaccactacccttcccaatgtctgataactatcattctattctctatctccataggttcaattgttttaatttttagatcccacaaataagtgacagcatgcagtttgcctttctattcccagcttatttcactcaacacaatgtcctccagttccatctatgttgttgcaaatgacaggatctcattctttttatagatgaatagtactccattgtgtactgtaccagattttctttatccattcatctgttgatggatactttggtagatcccaaatcttggctattgtgaatagtgctgcaataaatacagagtgcagatatctcttcagtatactgatgtcctttcttttgggtacataccgagcaatgggattgctggattatatagtagttctatttttagtttcctgaggaatattctaggataaaaagatttttgttttctttcagcactttaaatatgacatgccattctctcctggactgatatattgatatattgtatatagtctgctgccagatatattggaatgcctttgtgtgttattttttctcttgctacttttaaggttctttctttatttctgacctttgtgagtttgcttattaaatatcttgaggtaatcttatttgggttaaatatcagcgttctataaatttcctgtacttgaatgttgatatctttctctaactttggaaagttctatcttattatttctttgaataaactttctacttctacccagctgaattctgccctgtgttgctttccactgtgaccaggaagcactgagttctaatgcaaagtcccgcaatcactgcactcaccctctctcaagtgcactgattttctttctgtgccatgtggtccagaccaggggacggcggagggatggtatcagtaattcaagactgtctttcctaccctcttccatgcttcttttcttgatattatgttaaaaccaggtattgtaatcactcatccaagttttggttcttctgaaggtgctttcttgtgtgaatagttgttcactttggtgttgctgttgtggagtcgatcactggagggttctatttggccatgttgctctgcagaggcagtaattttgatttatcaattctattagtttataggggttttgtttgattccttttactaatcttatgagtaattttctcaaacttgtgtttgcataagagagccattttgtgtgtgctgaaaggctgtgtgtgtgtgtctgtgtgtgtgtgtgtgtgtgtgtgtgttgcttaatgtcaaatagattcaaactattggtaattttgaattgaccagctgttttcatgtaaaagcaatgataatcaacattttggtgagatagggaggtaacttaagattctagtaattaaccaaggtgtaagcaacttaaaattatttccatctgtaaaattatcatttcaacaaattatattgttttagagcaatgaccatgtcagcaatgacaatgacaatgtagcaatgacaaggacaaagttaattctggttacaaaagaaataattcttgtttagtgaatcaaagatctccactcaaaatcacaccatttgaattcttgcagactttgaagcttaaatagattcttagccttcacaacccctgggcatttttaataagaagcatagtgtgattctctgcttgggtaaggaaataaaacagaaatttttctcgaaagggccataaggtatattacatccaattagtcctatcttgactctgtgaagttgtcccaaataagagtgggtgataactgtttgtaatttccaaccacagaattcaccttagtttgtactttgaatagttaatgcttggcagtagcagcttactttaatataggggacatctggaaaataccttgtaaacgatgaaaccaaaacattcaattgtccaaaaatattatggagtgaagaacacaaccacatataattaacttaaatgtacagaggcattatatttgttaaataatttattaataatattatttttcagttcttttcattctttgcaggaagttattatacatcaattttaattattttagttttatattttctgttgtctcctgtgattatttaaatcagaattaccatttcctaaacataattgcagattgaaacatgtgactatatttcttattttaattttttgttttataagcttcatctggtacatattaaccatgaaccttactctcattcaattcagctcatggtcagataccacaattgaagtagtatcactcctataatatttttaccatttattattgaaagcagttgagaattaatgattttaacagaagtgacgtttgtatacagttccattaaacaattaagataatacttgatccacagaatacattggaaactttataaattagaaatacgctgaataaatagacaactcatgctgagaataaatgttgaataaatcaaacaaatgtttcatcatacttggatccttccaatcagttatctaatttctacaaatgtattttacatttatccttttaagtccatttataatgtcatcgctctttgccaacaatactaaatgttaattaaattttgaatattttaatcactattacattgtgattgaaaaaaacagtgtattcaatctaattttaatgtgtctcaacctcagaaaatatttttctctggtcatattttcatgagtaaaaattatttccaattatattttaaccgtgtctttttcattattttaaacagtaaaattttaatatgtttactcccttcttgttttatgagtctaaatgctgtaaaataacaatagccaatgtgaattacgcaagcattttaaaatgtaaaaaaaagcaccttgatatgaaaagaaatgctcagttgtactctcaagacaagaatttaataataaatactatgcttaatgaagacagtttctaaaattaaaaaaccccaaagtgatacataacacagatattagtaacaaaaagagaggctagattacttcttgctgattctcacctacaccagcctccaataaatttctttcttttgaaactgcttttcacctgcttatctaaatgtgacttctatctctctatccctcagtcctccatttgtcatgaattgttctctcacctactgttcccacagttcactctctgccctgaaaattgtaatagtttctgtgttcataacttagtcttactctccaatgatttctcatattttatgattactgttacattaaatgttttatttccttgaccacattgtaaagtcatggaggactggaagcatgttttatgcttttggattgtccattatattggatacagtgccacggtcaacagcgtattgtatatgtacatttatatgctcccaacatatgtaaccctcttcccatcatcagcttcttttcccttgtttcaatgtttctcaactgagtagctccagcatgcctaccagcggccaaatcaaattatcagtattttccccaatctaataaatcagtaagtcttatctagtattccttctcaatatatcttgaatttatcactatctcccattgacactatcgtaggtcaagccattgttaatctataacttagcttgcactggccttctaactggtgtaactcttcaaaattgcttctttcaaaacacttgcttattcagtagccagagtgatgtttctaaaatgtagacataagctaatttcctgcttaaaatcaccagttgttttttatttggctcatgataaagtccaagctaagcagggtagcataaaagaactattatgatctggggtctgtccactttgccacctcatgccaaatagctcccttcatcactctcaatgtcttgttataccaaattatatcaaatacctttccattttacataacagtgcactttctacatgtatctcctcttcttcatatatgtattctcctacactttaccagcatgtattgatcttagatctttttacaaaaggtttagatgatttctcctccactcttgaaagaaatattttatgttctccaaatttgcttgcataatttctttaaatttgcatgtataattcattatgtttctccctattttaacagttgtcatttactgatgttataagtattcttctgtttgcccagtcatctgtaagtaaattacatgcagagggctatgttttcccatagtttaatcccaaatacttagtaaaaatatgtttttaaaatatttttaaatgagtgatgggtggtttggtagatggatggttaaaagaacaattttttaatacataataaatatgagttgaaccatgagaaatgaaatttatagagcactggtacaataatgtgtaattttcctttaaaatgtctttaaaattcatttaataactcattaattttattatgatacaaataataataatgatgaagttgggcagcaaaggtaataaggagttacattattgagcacttaatgtatgctagatagtgtgctatgcccatttatattactattatacacgccactcttaattgcttattttcttaccaagcttgagaaaagagagtcaatcagactgtagtgagccagctccagtttctgttttactaccaaaacgatctactttatagcctttcatttcttgtctttatctatgcaatggagacaatatttgctgactttataacaatatagttatgggaactgaggcaagatgttgaaaattattttaaactcagactacagaaatttgatataagccattccttttctaaattgtaatttatgttccttcaatatcagaaaataatattgccttcattcatatcaaaagtactccgtatctgaatctttcattccagccgatctgatatactcactatattccaaatagttcatgatggcatgtgtgaagaaaatagtacattgtgcatttctgcactcttcttcctagttttaaccgacaatttagttctcatggttcccttttctgacacctttatctttatagagttttttaaagtgacatttgaacatatgtaagttacctcaaatcttttttggaataggctagggagaaaatgagacagaaattgtgaaaataaaatgccagtcataagataactgaaaataaatgaagattggctcacctatcaggttataataatttttttaaccacaacattacgattccgtaagtccgtaggaagaattatttcaaaagaaatttccaaaagggcaaaaagggcagagtaggaaacttgaaaattcatctcctcataaaaacaacacaaaagctaggcaaacaacaacaaaaatcttgtctaatttgacttttctagaattctgaaaactaactaagatgctggagaaattgggagaccatttgttgaagaaatacctactgaatcttggtaagaacaatgagctttgaggtatttacacttaccctggttccatcccatactcctcatcttagtgatggtagtcatgaaaatgtactgtatttctagtacaggtaatcagtgctggagggagcaaaacagacctcgctcacaaataattgttttagcccacctggtagctccctgaaagacctgcttaaagtcaagctaaaagtgcttgccttaatgtctcataacatggaactctcccagtgctgaggttgctaccccaaggatgtttgtcaaaaatgttcacaggcaaatataatagtcactgtttcctggggaagtgaataaaagttggggcaaaaaaaaatagattaattaaaagcttaggatgaaaggctggagattgaaatgctttggggaataaaggctttgaaaatttcacatattctgggaatccagagggccacacgtaggtacagggcagtgcaaatcctcaggaaaaaccgaaaaaggcattaatctctcgccactgactaaccttcggtctctgcgctggcaagaagtgaatgctagggcagggatggtacacggcctcactagagtttaacacacagaagcccatctcaaaattctgggagatgtttttggttccaggcaagtatagaaatctctgtccaatcactagctgactactaacctcacagaaaagagatgttattgaccacacatgacaaagaatacagactttatgatattaattcagaaaagtcactaaacaaacaatcaccataacaaacagaacatgaaactctggagaagagaaaaacctgaattccatgcttgctacattataattctcaaaatgtccagttttcaacaacaaacacaacaggcattagacgtgccaacaaacaagaaggtatattccatgcacaggaaaagaagccattcatataaactgcctctgattaacctgagacattggtcttagcagacaaatcctttaaatcagctattttaagtgtgttcaatgaactaaagaaaatcttgcccaaggaactgaagaaaataatgataacaatgtatcaccaaatagagagtatcaataaagagaaagaaatttaagaaatgaatcaagtagaaattctgaagctaaaaagtacacatttaaggtactaaaaaaaaaaactatcaaccaagaaaataaggcattccataataaataaaaacagttttcactaatagacttgtcctaaaagaaatgctaaagggagtacttcagactgaaactaatggacactagacagctacttgaatccacacaaagaaattaagaacatggttaatagtaaataaataggcattataaaagtattatgtaaaagtcattataaatgcatttattgttttaactcctctattttgctatctgatttaaaagacaatagcaagaacaataattataaatctacgctagtggacacacaatataaaaagacaatttatggcagtaacataaagtttcagttaggatgaataagctctagagatgtagcatacagcacagtgactatagttaggaattatgtattgtacacctgaaaattggtaagagagtagatctcaaatgttctcataaccaaaaaaatgataagcatgtgaggtaatgaagatgttagcctgatttaaccatcttacaatatgtacatatatcagaacatcatgttatacaccgtgtatgcatacatatacaatttttgtcagttatacttgtaaaagctgagaaaataaaattaaataaagaattcgagttcagaaataaatcctagtacttatgttcaattgatttcaaccaaagtgctgagaccactcagtaaagaaagaatagtcttttcaacaaacagtgctgagacaatataatatcgaaaagaaaaacaaggagtttgggccgctatctctcactacatagaaaaactaactcataatggatcaaacgcctaaatgtaagacctaaaactacaaaactctgaaaagaaaatatacgtgcaaatttcatatatttgaattaggtagtggtttcttaagtatgactccaaaagcacaagcagcaaaagaaaaaaatggtaaactaaatttaatcaaaattaaactttttatatattgaaatatattatcaaggaagtaaaaaaagacccatgaaatgagaaataacgtttgcaaataatatatctcataagggtttaatatccagaatatgtaaagaccataaaattcaacaccgataagataaacaacacaattgaaaaatcagcaagtgatctggataagcgtttctccaaagaggatatacaaatgaacagcaagcacttgaaaagatgctcagcatcattagtcattagagaaatgcaaatcaaaaccacagtgagataccacttcatacccactagaatggctaagaaaaatggaaaacaggccgggcgtggtggctcacacctataatcctagcactttgggatgccaaggcaggcagatcacttgaggtcaggagttcgagaccagcctagccaaaatggcgaaaccccgtctctactcaaaatacaaaaattagccggacgcggtggcaggcacctgtaatcccagctactcaggaggcttaggcaggagaatcacttgaacctgggaggcggaggttgcagtgggctgagatcttgcctctgcactacagcctgggtgacagagggagactccatctcaaaaaaaaaaaaaaaaaggaaaatattaagtgttggtgggcacgtgagagaactgcacccctgatccatcattattgggagtataaaatgatgcagccactgtggaaaacaattaggcagttccaaaacctaaacgtaaagttattatgtgacacagtaataccactcccagataaagctcaggcgactgaaaatagttgttcataagaaaactcatgtttagagcagcattattcacagtagccaaaaggtggaaataatccaaatggccatcagctgatgaatgggtaaacaatatgtggtatgttcatgtaatggaatattattcagccacaaaaagcaacacagtactagcacacgctacaatatccatgaactctgaaaaattatcctaaatgaaagatgccagacacaaaggtcacatattgtacgattccattattgtgaaatgtccagaataaatagacaaattcatggagacataaagcagattagtggttgcaagtggcaggagctgagaggaattggtagtgacggattaatggattttcttccaagagtgatgaaaatgttctacaattagattgttgtgataattagacaccattgtgattttactaaagaccactgaattttacatttttaaatcgttaaaatggtaaattttatccctgtttttaaacatttacaaaaaaatttccaatacaagttttcaatatacatactaatatggaaaacaatgagaatatatttcatggcttgttgtgcattctatgtgaggtttgtttgatgaaaacacctttcttttcaactattggtctgaaactcacaatcatgttaaatcaggttttcccaatatccatttgtagagtctagtacagtacatttttactaggatataagcattttgaggatacaaatatttcttgtttagttaactgtttgcaactagcttattgacttacaaataatgagcatatcaataagtagttgtttaataaatttattaatttcctggcttgggggaaggaaggtaacatattatcattggcagtgctttgtcgaattcttgccttcagatttgaatacaaaaaatatgatttattgtcatagctacaagtaggatagagcagctaatatgttaggttcacagagatcagtcaattgataaatatgatattatactaagacttgaattaacttaatcttcagaaacccgtggaagctttactttatgtaatatgattattattatcatctttgatttcagtattaaatgctttgtggctccttagagtcctagaacaatgtaaaagaaggtagagaggaggtccactttcatataagtgagaatttttagctgtcagatagttgacattaatgaacttcacatttatctcttcctaacagcaatttttaagcatatatctgttaatctaggtctttcattatttccatacataagcccattgcaaaattcaccaaatgacacagtagactgtcccttcaataatattattagaaaaaaagtgcactgttgggttcattttttgtagtttcttgtagcaaccttagttaaactaaagctggaactaaacaactaaagtttacttgcttaatttaaccttcagtctatgatattctcatgtctgatctttattttagaaatacatattataggcccagggcgacggctcatgcctagaatcccaccacttagggaggctgaggcaggtggatcatgaggtcaggagttcaagagcagcctggccaatatgctgaaacccagtctctactaaaaatacaaaaattagccaggcgtggtggcacacagcttgtaatcccagctactagggaggctgaggcaggagaattgcttgaccctgggagatggaggttgcagtgagccaagatcacaccactgcactccagcctgggtgacagagcaagactctgtctcaaaaaacgaaagaaaaacatatcatacctgctatgtacaatttcttttcacaatataataggtttggattttaccttttattatatttctttcctcaaatattattattttatttcagcactccttttgaattgcccactctgctttaacaataatgctgttgtttatttgtatggtgcctgaaataaaccatgctattggtctaccttggctgccatttcttattcctcatccaacctgttttctttcaaagaggctagctcttattaaagaaagatgacaccaactagtaatgttttgactactttagactcctgaaaactgtgttttccatcattctcttgaacttccataaagcttgtcctggttttaatctaattttcataagttacagagctatgcaactcaacacaagaagcaatactaataaaacttactccaaagactaccactggaaatgttttgttgttttgaatcttactatgtcattcttggaaaaagtggctttcatttccaatgagggtagatttcactttgtttgaaaaagtggtagaagaaaacgacaggcgaagaaccacttaaacaggtcactttgaaggagttctttatacttgaaattctattctctcaagttcataatttttataattgaaatataaaatattttattttcatagtaaacctcaaaaataaaattaatatctcatgagcaaactatctgaaaatgttcatgtattgctagttgtccaagagtagtttgaagatgactcattgcaacactggtagaacgggcatcatttgtctgccacccagttctagaatgaagagccgactgcattttgttgcacccaagacactatgaggaaggatttgctcacaattttgtaattgaattcattaaaatttttactctcataaatatttgctatcatttagagtttcctgtcatataaaaaatgtagagttttgaagatacaccaaaaatgtgtcatattggactcactcttaaaaattaattaatcatgcagcatgtaaaacatatagaaattataaaggatgtaaaaatgaaaacaaaaaatggaaattataaagaatgcaatagtcatatctactacctagcttaataaataatatattgccaaaggtcaaaatatttgttgtttctttcttcctgaacatcagcctctgcagtaaacttgtttctgtatatgactgtcttaaatttccctgcatgtttattgcatacatacggatccttaaacaacatccgggggttggagggtgaggcagggcatatagtctataatttgcagaaaatatatatgagtcaaggatactattgtgtggagaccagcatgagcaaaagaatagacccagagtcattgaggtactattatgtgtagggtctggtaaacatgggtcactgaaggcacaccatgattataggttctgaatagcttttttttcttcttcttcttctttcaagagacaaggtcttgctctgtcactcaggctggagtgcaatggcaccatcatagcctgggttcaagtgatgctcctacctcagctccctcagtagctaggactacaggtgcatacccccacatcttgctatttttttgtttttttctagagattgggtcttctgtgttgtccaggtctgtcttgaactcctggcctcaagtgatcctctaatttaaacccccaaaagtgctgggatcagaggcataagccactggacctggtttacaggtcctaaatatctaagagcaatgccaacgtaagtccaatgctacacatcctctctctccaaatggctcaaaatggaggcaaaggagtgggactccaagacagaagatgtgagtgaattagaggaggaggagaaacaaaagaaacaaatatggggatatcggcttatagccatgtctacatttacaacaaccctgctcttttacctgcaacaaaataatctaaaacagcttattaaaaatagattagttttgttttattactatggcattaaccagtatgtgttcacaaatgaaggcagattgggaatagacttcgcttcactttcaaggttcctttcctcaattaagtctaaaagaggagaactatttccccactccctcatccccatgaaaaacaaaagaaaagaaaaaattctgtatctttaatttttttctaccaaagctgatacctgaaaatcttttacagctgcatctgctatttcctgctcagccctttcttaactctcttagatatgagctaaaagaaaatatgcccagataccaccttaccctagcagcatattctctacctgccttacccactctgtgtgccaacccacttgttctgatgcctgaggtagaaatagtagagttttggctgcaaaatgctttcttcttgcatttattatagatgacaaaaatattttggagttaaatggtgagatggagggatttttttttaggtcttatatttgactaaagatttgtgtttcttgctttgtgaaaatttaatattttaactgtattccagcagccctatgaaagtaggtaaggtagatgtactaaacccattaacatgataaggcaaccagaggctcagtggattgctaagatggtgaattgcttttttactaggtgaaattatatttttatggaaaggacagaaggagcagagtttgttttggtcttttgcttcgttttttgtaaatgtgcatgtgttagcaaaaacacaaagcagcaagaaaccaaggatgtggtaaattattcactttatgacttcaaagagcttctcttttatgactagcagcctcacagatcaatagataacgggtgtaaataagaatcatagaatttaggagttggacaaggctttgaaggttattcaggacaacccctcataaggagttatgttggtccaatattgcttggaaaagatgggctaggccagaccttccagtctagtctgagtttgagtttgtgtgagaagtttgactggaactaggtacaagcctactttttctttgatttacttacagagtaggaaataagaagggcaaagattgccaaagaactaagaatgctttgagggttaaaatttctgctgcgttcgcactggggcactcttgtacctgcgattgctctgcggggcttaggagatttcccatattgcccagtatgggcagaattgtccacaacctgccacaagaactaacccagactctgcgagaacattcccccacaatgggtagttgatatcatagaactttctttctcactgtaggaaaccctaatttgtcagcctttcttctactgctttatattgaaagcaaggctagcttttaatcataaagggacaaaaaaaaaaaaaaaaaaaaaaaaaaaggcacactcctagttaacacccagcttctactgctcttttagaagtccctttgtttcatggagaccagaaaaaaccatttacatttccaactctttgtcttttttattttattttattttatttttcactcggtctcccaaactagactgcagtggcgcgatctcggttcactgcaacctccgcctcctggattcaagcgcttctcatgcctcagcctcctgagtcgctgggattacaggcacctgccaccacgcccggctaatttttgtattttgagtacagacggggtttcgccatgttggcaaggctggtcttgaactcctgacctcaaagtgatcctcccacctcaacctcccaaagtgcagggattacagacgtgagctaccgtgcccggcctctttgtcttatttttgcagcctgaaacaaagaaaaagtcaacaatctttttttttatttttttattttttgcaagccagcccttcaaatacttaaatgaattatctctatttcacaaccattcacagccttggtcttcatctttgttttttgtttttcttgtccccaaatcccgacacatcttctcccatgatacaactccctattctgttgagtgccttcagcggaacactctccagtgtgtcactgccattataaaacgcagatctcttagtgaccccaggtgaatctcaatccttccccctgaatagcacgtttcaactaggaatccattcgtgtctatcttggtaatcctatacagtcagtcattccgctgagggttccacctaagggtgaccccaaacgaagggagggaggaaggagaaagaaaacaaaggtgaaagaaagaacaaatacagaaatataaggaagaaagaaaaagataaaaagaaagaagagggaggaacagaaggaaagatttaaaaagaagaagaagaagaatgcatctactttagcatattttcttaataaatcacgcaagttttaaagagtccccctcttttatcttctaaggtctcacaaactatttgataaacattacagtaggtatttcttttttttttttttttgcctatataatatgcactctcttttttctctaataccaatatcctaatttcctaatgaatccaggctccgtcactcctaggacaagtgctttgtgtggcagagctgtgtccaatgctagctttgtagacacatggtatgctgttctgaacaatcagatcactttatttctccaaccatgacaactggttcagagatggacatctgacctattcagagccattcagaattaacctcagtttttattgagaaaaccagaatagattctatttcaacacgatttggaagaaatcttgggaacattagtgacctcaacaggaaaaaaaaaaaaaaaaaagcaaacgtggaagaaaaataagctgatggcggggacgggaaggagccaggagataaaaacagcttcctgatagctggaaatagacaaagcaagctgcggttagttctactggagacgttttcccttactgatcttttttgtttaagcctcttgtagctgagtttcttttatttgcaacagaaagagacatgtctaatatttattttcccaaaatatgcatcaaatttcacttctttccaaattgattatttccagtttaaaacatgaggatgatgcgtgcacatctttagtactctcaatgtttccaacccttatcttcaatgtaatttactaacaattatttaaagctccctctctcactattgtaagctacacgaaggcagaaagcatcacttattttaatgacccttatagtttagtgcagtgccaggcacttagttaacacaccatataaatgtctagatagatagatatatagaggtaggtgataaagaaatttatatatatatatacactatatatatagtatatataaagaaatacatatataatatatgcatgtgatagaacgaaagaaaggataggtagatttatcgataggtataaagcccgtgggctgtgacttatgcctgtaattctagcaatttgggcggccgaggcaggtggatcactttagcccaggagtttgagaccaccatggacaacgtgacaaaaccctgtttctataaaatatacgaaaattagctgggtgtggtggcatatgcctgtagtcccagcactcgggaggatgagacggaaggatcccttgagcctggaacttcgagactgcagtgagcggagactgtgccactgcattccaacctgggcaacacagtgaaatcctgtctcaaattgatagatagaataatagaaataattaaatgaacgttatgtcaacttccctatggtctatacatcttcagcctttaatagcgtttgctttgggagctcattcacaacatcttttattattctgacaggtttcattggatcacgttctcctgaatgattttccccttctccctttatcctgggttatcagtttttctaactaaagaatgttcattttatgctaggaagctgagctcagagagatgctcctcaaatttttaatcttagaaaattttctgggaaacctatggacaaggtgctcacctcgcttgcaagaacaagcttagtatattcacaatcatacatttcattgtctctctgagggtcaatgtttcttgctgaagctcataatggatttgaaaatccttgtaatgcctaactcccctttaaacaattaaccagagtctcttggttcccttggagactattctaagacttaaaattgtttttcttctcccctgcccacactgcagctaaaagctatgaattaccacaataaacaatattgagaaatgtcaaaaatcatcatttcatcccatggaaaataatcaaagagcaaagatagagattcccttcctatttatgcacttgtttaagaagtgtctgacctctgtgggatcttctgggaaaactttgatattttgactattcgttattaaaaattcatagatagagatgaaaatgaatcatttactttttttcaatcataccaaaattggccaaatggcttttgcagctgacagtttccagttattctttgtgatggaaaagggctatcaatttatgaaggaggaggcatgatagtgacatccataataaaatttaagcaataatctgtacacaaataacatatttatcatccctcatgcaaaagctaagccatttgcaatttgtaaacttacattaagttcaaaataaagaaattttaaaaatgcatgctagttaaataaaatgcacagtgtttataattgggaaacataatatcaataatgatgatggtgatgattatagagagaaattatataggtttaaaagtatgccaggccctctaataagtgctttatgtaaattgattcatttactccttccaaagatcatttgaggcaggtaatcagctaggaaaaatattctacagagtatgcagtaggcacagcaagtgccaagggtctgaggtgagaatgagcacagcatgttgaagaagctaaaagacagagtagataatatgtcttttacataacaatattttatatcaattttcatttcctttctagtacaagattatttagaatattaaaattttcagttaaaattgttttttttcccttggctattcttttctgttgttttttttaaatattttgtttccataatgtggactcaattttcagtttcatataatttgtttttattttaattttgaaataatatattaaaatttaaaatattatttcatgagtgttggaaaaactgtattgttgttttaagattacagttctgtgtgtgtgtgtgtgtgtgtgtgtgtgtgtgtgtgtgtgtatgtgtgtgcatggctaccaaatcaaatttttagtagtttgaattttgctattcctctttgagtctaatgtcaaataaattttgtatgaagtatctttaaggctctaacatttaaggatcagtaaatttgtctttgtatttccatgagcttaattttgtatattttgatgctgcattttaaaaataagttacactcaagttttgttttttattgtattttaagttccaggatacatgtgtagaatgtgcaggtttgttacataggtaaacatgttccatggtgatttgctgtacctatcaacccatcacctaggtattaagcccagcatgcattaactatttttcctgatgctttccttccccctgcacactgctcccacccctcaactggccccagtgtgtgttgttcttctccctgtgtctacgtgttcacattgttcagctctcacttataagtgagaacacgcagtgtttgattttctgttcctgtgctagtttgctgaggataatggcttccagctccatccatgtccctgcaaaggacatgatctcattcctttttatggctgcatagtattccatggtgtatatgtaccacattttctttatccagtctattattgatgggcatttgggttgactccatgtctttgctactgtgaatagtgctgcaatgaatatatgcatgcatgtatctttataatagaacaatttatatttcattgggtatatacccagtaatgggattgctgggtcaaatggtatttctggttctaggtctttgaggaaacaccacactgtcttccacaatggttaaactaatttacattcccaccaacactgtaaaagcgttcctattggtccacaacctccccagcatctgttgtttcttgactttttaataatcactattttgactgttgtgagatggtatctcactgtggtttttatttgcatttctctaatgatcaatgatgttgagcttttcttcatatgtttgttggctgtgtaaatgtcttcttttgagaagtgtctgttcatgtccttcgtccactttttaatggggttgttttttcctcgtaaatttgtttaagtttctcatagattctggatattaggcctttgtcagatggagagattgcaaaaattttctcccattctgtaggttgtctgttcagactgatgatagtttcttttgctgtgcagaagctctttagtttaattagatcccttttgtcaattttttgcttttgtttcaattgttaccaaaaaagagcccatatagccaacataaccctaagcaaaaagaacaaagctgggggcatcatgctacctgacttcaaactatactacaaggctacagtaaccaaaacagcttagtactggtacaaaaacagacacacagaccaatgaaacagaatagaggactcagaaataagattgcatgtctataaccatctgatcttccacaaatctgacaaaaacaagcaatggggaaaggattccctgtttaataaatggtgctgggagaactggctagccatatgcagaaaattgaatctggacctcttccttacaccttatacaaaaattaactcaagatggattaaagacttaatgtaaaatcccaaactataaaaacctagaggaaaacctaggcaataccattcaggacatagacaagggcaaaaatttcatgttgatgctgtgtttttttatgtatataaggttttatgattttacttttaccattgtaaaatatgattagcttgtctcattcatcttttttttctggtattacaatgggtttcacagtgttggttcaatgcctgccttttgttaaaatttgcccaatttacttttaccatcattttattattatactttatattgtcgaatttttaactttctcactttcacacaacatatagctagatatgggattgttgttcatttgttttctcttctttctttttttttcttcttttctctccctaatgttaaagcctctgatttataaggaaatataactcatgtttattatgcctacaaacatacttagtatttcttaggttgagattcccagcaagtggagcctgtggcaaaggctggtgtgcttctgctccattagagtgtgatcccagggagaagtagtgagatcaagtacagcaaagcagggaagaagggagagccaatagaaaatgtgccatggggctgagcattacaaggtaaagcagatgtttgaccttcaggatctcttcccccagaagctatatgactgtggctcagaaccgtgtgcccaaaggagacagagaggataatttatctacacacatctgttgcccatcactcaaaagtctggctgatagggggttaattctgccccaccacccacccctacacacacatatttcggttggacataggtgggcactgacgtagattctttgcttcctgtacttatatgtgaatagcaaagtgttgagaactggaagcatgagtgagtgacatgcaaggaactgacattgaagtaagattctgtgagggtgaggttgcatttgtagaaagtggttatagtccacttagcaatggtcatcacagaggtggctgagggaccagtagatggttctgaaaaggtaagtggatgctacctaggtttgtttagtcttctttctagcagggtttctgattgggtttcatttattttattctcttgtactgaattgtcttttcctatttttcttttttgttttaagcattattcatcataggcctaatagttgcccacatatatttaatgtgtatgtttatattataatttttgaaggataatttgaattattatccatttagaaaatgaccataacatactttcacatttcttgtgctctaccttcttcacctcaactagtcaccctttatatgctctgggtttcatattgaaaatatatttgaaatattcctggatcattacacataactctgtaacatatttattttttaaattctggagaaatctatttttgagctcactagtttcctttataagtctatccatttctcaattcaacccactcatagagttttttaattacttttttcaactaaaaattgaatgtttaaatctaactcttttaaaatgaccactgcttaacataaactgggaagagataagggagtcatggcccatctgttccagtaatcatccagatggacaaccaggtggcctctgccttgcttacaatcattaactgtgaacctggaggactgctacaaccaaccttagcagaagatctgaggatacaaaagtttagggcaccagtttcttatgttcttttttttctttataattcttttaatcttctctttatgtttcagggattcctcaaaatttgcaattggttgatggcactcttcatctttctgatgttcatttagaagtggtatgtgtgcgtgtgtatgtgtgtgtagtgtgtatgtagtcattcttaccagtagtgcacacctccccccccaattctctcctctatcctactttgttcttttgatttttttcatttcaagggattttggaaagtagaagagtaaaattgtatagtcaatctacaccctttgatacaatctccagtgcactaattaattttacatttttatcattgttagtttttattgaaacacgcatgccaaaagaaaaaaaatccacccaagaataattgaattggtgtatctgagtttggtagataatcctttaaatcttaaattgtgttaatctcagcatttgcagagctattgcctgctatcctgtagtgaacccagtttctaaatcagagcaatccttaattaaaatgggacattaatcaacagcaaactatttgcatctaccattattctaaattgtgtgacttgacaagatccacgttattgcctaagataaacattaaatatataaacttcataaggcagaagctgtttatcttagtcttatctagaaaagacattacaaataaggattcattaacttattcattttatatatatgtatgtttttcacgttatagatacgtatattattctttgccaattatattgtaattatatgctttaggattaaataacagttgtaattttttgtcacacacatgcctgcatgtgtaggcactttatgcatatgaacacatttatatttcttatttatacatcaagattatgcaaaaaaatgagaaaaaataaaaatatgaaaatgcttaattcagttatttgtgcaacctaaatataaaattagagcatgcctccaggatctaatgggagtcttaagggtccattagatggcacaattggtttaaaattataatatctctcaaatttttaaaattaaaatttgccttcaatgtaaagcaatggtaacaacaaactgttagaataacatatggcactaaccaaattgattctaaatggccacctgtccctaatatctatgatttcctccacagataattactgggaacctgatgctcagtactgtattaggcattaaaaggatgaagatgactaagggaacaaaataacagcttagaataattctctcctttttagagtttttccctaactttgtcaaagtataattaaaaaataaaaatgtctatattttcagcatacaatgtgatgttttaatatacatcttcattgattaccacagttgtgcttattaacatatccatcacctcacaggtttacatattttttttgtggtgagaacatttaagaatactctctgagtaaatgttaagtatacggtacagtataattaatgataggtatggtctattggatttccaaaactaattcattctgcataactgcaactttatgtcattttaccaatgtctcctcttttccctcactctcaagacactggcaatcatcatttttctctctgtttctatgagtttaagtttttaagattgtatatgtgagagtatgctgtatttgtctttctgtccctagcttatttcctttaacataatgttttctatggtcatccatgttgttgcaaatgacagaatgtccttttttttgtttgtttgtttttgtttttgttttgagacggagtctggctctgtcgcccaggctggagtgcggtggcgccatctctgctcactgcaagctccgcctcccgggttcccgccattctcctgcctcagcctcccgagtagctgggactacaggcgcccgccaccacgcccggctaattttttgtattttttgatagagacggggtttcaccgtgttagccaggatggtttcgatctcctgacctcgtgatccccccgcctcggcctcccaaagtgctgggatcacaggcgtgagccaccgcgcccagccagaatttcctctttttaaaaaaagaaaaatggccgggcgcggtggctcacgcctttgatcccaacactttgggaagtcgaggcagggggatcacgaggtcaggagatggagaccatcctggctaacacggtgaaaccccgtctctactaaaaatacaaaaaattagccgggcgtggtggcgggcgcctgtagtcccagctactcgggaggctgaggcaggagaatggctgatcccgggaggcggagcttgcagtgagctgagatcctgcaactgcactccagcctgggcgacacagcaagactctgtctcaaaaaaaaaaaaaaaaaaagaaaaaaaagaaaaatattcctgtgtgggtgtgtgggggtgtgtgggggtgtgtgtttttgtgtctgtgtattttctttgtctattcatctgtctatgaaaacagttgattccgtatcttggccattgtgaataatgctgcagtgaacacaggaatgcagatatctcttcaacatactgattttatttcctttgaatgtatacacaatattgggattgctggattatatgataattatttttaattttttaagaacctccatactgtttttataatagctgtaacaatttacaatcccaccaagaatgtacacgggtttccattttttcacaccctcaccaacactgattatcttttgtctttttgataatagccattctagccattctaacaggtgtgaggttattgtggttttaatttgcatttccctgatgattagtaatgttcagctttttttttttcatgtacctattggccacttatatgtcttcttttgagaactgtctcttccgatcctttgcccattttttaattaggttatttgtttttgctgttgagatctttgaattccttatatgttttggatattaatctctcattgtatatatggcttgcaaacaatttctcccatgtaggttgcctcttcattatgctaattatttcctttgttatacagaagctttttagttgatgcaatcccatttgtctatttttgattttgttgcctttgctttggggatcatatccaaaaattatttgcccagaccaatgtcaaaaggggttttttcctatgttgtctttcaataattttatagtttcagatgttacattgaagtctttaatctattttgggttgatttatgtagacagtgtgagataagggtacaatttcattcttctgcatttagataagcagttttcccaacatctttattgaaaagactttccccattgcatgttcttgtcatctttgtcgaagatctgttgacaataaatgtgtggatttatttctgggctctctatacaattccattgggctgtatgtctatttttatgccagtatcatgttgtttttattactatagctttgtagtatatttcaacatctggtagtatgatgccttcatcattgttcttgtcaggattacttttgactgtttggaacttttgtggtttcatatgctttaggatttcttttgtatttctgtaaataataccattggatttttatggggcttgcattgattctgtatttgttttgaatttttaacaatatagattcttccaatatataaacatagatttttttgtttatttgtgtcttcttcaatttctttcatcaatattttaaagtttaactgtacagatcttttatctcctttgctcaatctattcctaaatctgttttaaatgatactgtgaatgggattgcttccctattttcttttttgggtgtttcattgttagtgtatagaaatgccacagatttttatatgtttgttttgtatcctgcagttatacactgaagttgcttattagttctaacactttttcaatagagcctttaaagtttttccatatatacagtcatgccatctgcaaagagacaatttaactttttcagtcaagattgtaatggatatcctccagactgttcagttgtttccttacagaaatcacagttttaccctcagtaatctcaatacaattacaaagacaaataaaaggatcagtatgtctttgattttgttggaaatacattaactcagcttttactcagtttagcatagtggtaagatgtacaggttttgacattagacagatccaaattccaattctgcttcctcgaatcgcgtgctgatgaatttaggcatgttacttaacctctctgagaatctttcctttctttttttttttaatttggtgagtgagcataataatcacaataatcgaataggctatttttcaggtctatctatatatatatgtatacgtatataatatttatatgtatgtataaaacatttagcgtaaaagcattcaattgattttaatctccttacctgtaagtgtttattttggtgtgtattaacacattgtgtgtatgtttatatagtgtctgcatttaaataaaatagatttaaacttaataacctggaatgctagatttatatcatcacaatttattaggttaaaatgtgggtgctctaaaacaaacaaacacaatgcaacccctcaggctcatgaaagtaaaatgagaaatacattatgtggtgataagagctaatacttcatgcaaatgtgacattacacatctctttgtgtttaggactatgcttgtcagctatgcaaatgctagccattatttcttaacacactctggtccttaaatagcaccaagaggaatgttctatatttcactcatttagtacattattgtattgtaatttttaaataaaactaaaaagaactagaccacataaccatctttgatcaatgttcagaacaaatatatggcagagaattattaaacagtacctcaagcatgctctttccagagggcaatggattatttagtaccatgtcaaatcacataaactaattcaaaaatgataaattacaatgaaaatgcatgctgatgttttgtccctgaattctaataatgggtgtaaaacagtgttaactgtcattgatcagacacatttattggcatgctaacctaacaattaccatagtattgactatcaaacagccatatgattatagtatatgatgtactatatagtatatgattatagaaaagatatagcatatgggttcatttactctaggaataccaattataaatataagtaagtgtagaatactaatttgttaattaaataaatatcattttaattcacaacagttgacactctggttctccttgactccctgagttttaaataagaaaatgtattaactaacttagaattttctcaaatttatttatcattgcacttagccttcacctaataaaaatgtttatttggctttaggcgtgaaatttcccagatagtcaaaaacaaatctgccaaatcaatgccaataatcttctaagtattttgaatattaatatttatgaaggacaaaaggttacttttgtaatgttgcaattaaatgtctattttctcttcataaatagaaattaatgaatcaatgtttatgcaactgactgcttgccaattaaacacttatcttaggaattcataaacgtcctttctcttcaaagagtcagcaatagaaaattctttcttttttctcttttttataacctttcttctacctacttttttcttattctccctgcctatttcttgtcattctctttgttctatactcttttttctttgctctacatcctcctccacgtcccatgcagtgtatggtgttaactcatacaaagcagtgcatgtagagactatgttattaaaaccccaggggtttggtctaggttccattgctcactgcacagaaagccaatcactgagacaatgagtgttgcctgggaagagagatgggagccaaagctcaaatctatccctctcacccaagcaacattgggggtttatatatcagggaaggaatttagctatgtacagaaagcaatcatgacaaatgagggttctggcatctgtctggattcggtgatcaggtgagtttctgttccttccttgcctgaaggttaatttccctagggaggaactcagaagtgagtttcaagttttaagaccagaaggggcaatttctatatttatttaaaaaaaaaaaagtaaacatgagctctacggagcatttgggcttgtttcagcagtaggtgagggcgtggctgaggcctggcagggaagcgatgttcacaatgcctgatcaccttagtttaaaacatttagaagctgagaggaaatttcctggtcaataatctaggcacctcaaaaaagtttccattatttttttttcaaatacacagataatttcttggccaaatttcttggcaatgacactgaggcaagaccagaaatgaatggcttgaaagaatgagaacagcaaagaagaattgtccagttgttcaaatgagagaatttcagcccacagttgaggtaatgatagcagatctggaaaagacagggacgatagaggaaactataaagaagagggacactgtagaattcagcaataggttgaagaaaagacagaaatgagtcacagattggaaatggaataaatgcacattgatgccttccttccccactgttttttttaaaaagcacatatatcacctgatggttatctgaacgagagcccgactgaagaggctgacaatcagactaagccaagcagacaagtaaaatagctatagggaacagtcctagaaacaggttttacagtttagcatagatatgtcttttttcttaaaagaaacaatcttggcttatattttattcataaaagctattctttactctgttgccttgagtgattttgcctatgtgtagatgtgagtacagcagctttaaattcacctgtgcccttgaaacagcagcctgtagtacattcaacatcgttgcactgactgctgctattctgccttctttgtgagccaattatgaatctatcttcagaaaattgtgctccagtgctattactgaattaacactttgcttaagtgtgttaattcacagacacccacatgtgtgcctacatacaacctcagagaaaatgtgtaaataagtttaagagtagcaaaaaggcatgctttttatgaaaagcatttaaagtgtctaaaattttctatttatcctgttaagagagaagggtgcagggatttattaatattgaatgaaatgatgtatattgaatagaaaatatattttctttttttttgagacagagtctcagtctgtcacccaggctggagtgcagtggtgtgatctcagctcactgcatcctccatctcctgggttcaagcaattctcctacctcagcctcccaagtagctgggtttacaggtgcccaccaccatacccagctaatttttgcatttttaggagagatggggtttcaccctgttggccaggctggtctcgaacttctaacctcaggtgatccacccacttcagcctcccaaagtgctgggattacaggcttgagccactgcgcccagccagattatattttctttaagatagaaatagtaggcataatcttcctgatcttcctgattttgtcttccatgttaaagaacatttattgtctgtctaaaatttaatgttcatgtgtacatggaatttaaagacaaaagaatacattccgaagaaaaacttaacttgtatttccaagtcctatctttacatcagaacaccctgtagagctttaaaagttctaaaacctgaattccaccttgagaagttatgtttttaaaatccccactggtcaattgcatgcatagccaaagtggaggatccctgtattagggcctgcctgtcgctaggcgcagggggtggcagcagggcacagtggaggtgggtgtgtggtggaaatcacttccaaacttacctagctctaagatgggctgttagagggcagttccttctaaactttaaatctgaaatcaactgttcagtttatgattctgttactgtataaccctgaccttgaatttatctgggtcacctttgctttgagaaaacagcctgtctagaagagcagggattttgtaatcagagatttgaactgaagtcttggctctggccatttactactgagatacttaggtaaattactgaatctcttgtaacatctgtttcctcactctataaagtagagtgattaaaaatatactcaacagttccaaggctgttcaagttcaatgaaagataatctgtgtaggattgaacacacaggaagtgctcagtgtgcgttaatttctttctcctttactgaatggtagcttttttatactcatttgtgctccttataaaataggcaaagttaagggaaagtgattaaaatcacatgagcctgttctctatttggctgtatctctgtaaagagtgagaagaaggttggctgttttaatttttaagacagaaaaatgattttttgattttgttttgatagagtcttgctctgttttcctggctggagtgcagtggtgcaatcatagctcagtataaccttgaactcctggattcaaatgatcctcctgccttagcttccctagtcgcttggactacaggcacacaataccatacccagataacttttttaaaattttttttcagaaataaggaatctgcccaggctggtctcaaactcctgacctcaagcaatcctcctgcctcaacctcccaaagtgctgggactacaggtgtaactaccaaaaacggcagggaaatgatttttttaaacacacatagcaaaatgtttttgtcttaatatgtgatgcccaacttaaaatagttacctttaagagctgagaggttattccaaagatgctgcactgaaaaaaacattcatagccacacgtatgaaattgtcttccagaatttagggtacgtgaagcaggatggaaatgcaatcgcaaggtcctagggatacaaacctgggacaaacaagcaagtttcctgactctatagaatttacctttcagaggtagacagatgttgatcaagtgctcctacagaaaactaggacatgtaaaataactaaggatgggaggggagcaaatgtagaaaatggtaaaccatttcgaaggtaatgagggttgtccggggaaagagatgatgacaccctggactaggtttgggtgctggagtcaacttatgtaaattatttaggagggagagccaacaggatttgcatatcatggggatttctgcatgtattattttagaggtgaaatcaatgggacttgaaagagaagcttatatgtgatatatctgacttgagcaaccagatgaaccatgctgctagtcaataaaattggcaggattaaataaatctcttatatgaggtagaagaccacatcttgaatacattgagtttgagatgcctttggaccatccaagatgaaatgtcggataagcagcaggagcgatgccttggtcccacagacaagagagtgagaagcagttatacgtgggtcatggtataaatcatatgatggccagtgaagccatgagtgtgggaggtcatattcagtgaaagctcagagtgagaagagtgcctttacacaagtttttattaaggacttcctgtgatagcattgactgctgatcacattggtgtttgcataaaatagcataatctaatccacaaattctctttcttagaagttgtttagaagtaaaagcaaagctgctcttcaataaatgtctcttgcacatactcagcaatcctagaagagaagccaaaagatacaatcagtatgtaaaggtacgatcagtgtgtaaagatacagtcagtgtgtaaagataggtcagtgcttagaatgatcgaggggaagtcccagatgaaaaatgttgaaggttgtctggccatgtcagtttcaaacccaaatgaatcctgagatttttatgccctatagaaatagttactcattaagattttatcaaaatagtctccttgaaaaaataattctcatgtttgtcagctgcagtgtgtaatctaaaatttaattagagattttaaatatctcttgaatctctgatagcagttttcaagacatttgaggcttattagctcagcccattttactgcagggaagaatgagatagcaatggtgaactttttttttttttttaatgttaggcaactccttttattccataatgagaaaacacctgctttttaattaaaattctatttctgtatacctttgtttgagtagttgaatcctaaatattcaggggcagtgagtccatttaaaactcataacaagtaaaacttcttaaatttaattgtacccttcaggttcaaaagtgctttggtaatttgggttctaaacagaatgtgggaagcaattaagggaggctgctattgtgaatcatgcatcacactcagaatcgaaagacgtgggttttcattcaccctgtgctacacacaggatatgtttatgagctgagctctgtggaagcagagacatttcttaacctcccaatctccacatctaccttataaagatttggtaggttttgttgtttctgttgttgttgaagttttaaagtttatggtgaaatatatgtcagacattcaggtaagaataaaatattataaaaagtattataataaacattaggtttctttaagctaacattaggaagtaattacttcagtttattttttaaggaattaaatgctataaacacaattgagatcctttttctacctttctcccatatcatttccttccctcctcctccactatacatacaattaggaattcagtgcacataaaaatatttttttttagactgaaggactcctagatccttatctatgactatagagaaacagatcagagagtgtgctaaatctataggtgctggccctgtatatgtcaaaaggataataatttctataaatgtattctgtacttttgttacataattatgtattgataagtatatgtaattttttgcactatgtgttaacgtttatcgaaatagcactacgtgtacattacactacatgtaacattgaacctcttgcttttttactcaatatttttttgagttttctctatgttggtaaaggttactaattcattccaagttctacatcatattattccatttacaaatgtagcataatatagtcttccatattcctgctgatggatgttagattgtttataatgttaaattgttcattataaataatgaagtaatgagcattactgctcttgaacatgccttgtgttcatatgtgagagttttatacacaggatatttctttcttgctgtagactaaaattgttcacttttactatcacactgctatattgttttccaaagtggttgtacaaatttacacttccaatagcagtgtatgagagtcttatttttccatatttctgcaaatatctagtttttccttttttgtatgtgtgcctgaatttatctcagactttcatagctaaatttttggggccacctctactgtcactactaacatctccatgaatgccaccatctccctgattctttccatgcgagcattgtatataggtgcaatggaatgggccaagtgctatttgtaatcatggcagctgtcgtctaatatataactctatataatcaaaataacatgagtaaaatctttaatctgtcttattcattcattatatgttagttaaatgttggcactaagaataattataattctgatttaataattaaaaagataaaagaattatataattttttatgagaacacaccagattcaccatgaacttcaaagagggatacataaaattctgcccttgtgtggatcaaatacatgacatctaacctcaccggaaaactggaaaattagtcaaaatagcaaataattatgtagcttcttccatcccctctttgacattccctaatttcacataattctagaattaaaaggaatacagtaacaaccttgcctaagtttcttatttaaaattcaggaagaatattctcaaattatgaatcctaaagaggtgaaatgccttgataaagtcacataacaacagattttcacctttaacttctttttcctgatttttggcagcctgagaccctgcagtgcagtgttctgccaaaacacgtgggcctgttgccctcaagaacagcccaagccatcaagatttccctgactcacttgtttactctaacatctcacctcctttttctgtaatatttcaggactttcctccttgctaaccaatctaataagctaatgagccagcactggcagaggtttaatgttctatccattctcaataatattgcccaagagggaaatttttcagccagtttctgttgaagcctctcaaaatattactctacaactatcaacctaatcttctcaaatgtaggcagaaaaacaaaaatcacttcagtcttttctattttaatttactgaggtacactaaagaaaacttctctatcattatccacctcataaaggcctgagacaatcacactcatcacttaaattcagacataagcatggcacgctaatgaaactaaggcaaatatgaaggtaacagtttatttttaatgcctattaaatattgttaaattaaaatgaaacatttaagaaaatatatgtgacattcaaatgaacaccaaatgattcatttcacactagtcaatattaaattaactccatattacatgaaaatgttaaatactactgaaataagcagcaaaagaaaattatactgtaacctcacaaacacatcatggttggaaatttgttattcaaaaaagattaagactaattttgtaaaactgttttaaagtcaattatttttaaaaagaattacgagaaaatatcatcacatcagtggttccattatatgttttaaattaatgaactaatgaaacccactaaaatgtaggcaggtgtaaacaaattgctgtttgtataacgcaatacttagtaaagattatttaagtagtatgctaaaatctaaacaatacgtagagtctataaaggataacttttagaattacgtttcaaaattaaagttgaaataataaactgaagaaattgctaacctaatcaattctgagtttgcaatatacaacacgggattggtcacctgatatcaatatgtaagttgtttcaaagtgcaaacttgattttaaaaagtttctttggtcttcatattaaagacatatttaagtatcacagataaattactcaagttatcagttaaattgctcaaagagtaacaccataattactatacaataatattttgattattttgacctctataatcatgctgaagagatatttataggttcttgattaatgggcaattttttgatttagattaattctatgataaacttaaggttatcaagtcttattttttcttcaataatttaacattcacacacagacacacacacttgagtccacgcttgagtgcccactctacaccgtgctgggactcagaaataagaaatcctcggccgggcgcggtggctcacgcctgtaatcccagcactttggggcgctgaggcgggtggatcgtgaggtcaggagatcgagaccatcctggctaacgcggtgaaaccccgtctctactaaaaacacaaaacattagccggacgtggtggcgggcacctgtaatccaagctactcaggaggctgaggcaggaggatggcgtgaacccgggaggcggagcttgcagtgagctgcactccagcctgggcgacagagccagactccgtctcaaaaaacaaaaaaaaagaaaaaaagaaaatccttaaaaaaatcagagattaacggggatgacagacaaactaggacacagtgttgcctgctatgcatgggaacgttagcagaacactctgggaggcccagaggaacagtgtatattggatttggggtggcatcactttctcaggggagtgttgtgtggattgagtcttcagggactagtacttgccagctagacaaattggtgcatactggggctggagaagcagcccatgggaccacaggaaaagcagcagcagctggtgcactgcactctggaaactatactacccaaggtcagtcatgagatgagcttgatgaagtgagagagaagtgtctagaggaagggtcagtactaaatcgcaaaggcctcacatcatgatgagtgactgcagcttgatgaacagatagagaagtctgcaaaaaaaggtcaacagagaaatggcgttatcagattgattttccagaaagctcctactagttgcctcattgttgttgaatatttcctacaattggaaacattaagggcacataaggagaggctttgtgatgatggcccaaggctttacctgggattgaccatagaaggaagggtcagaggctatgctatatttatggctaacagccttgtatatctttttttttagatggagtcttgctcttatagccaaggctggaatgcagtggtgccatcttggctcactgcaacctctgcctccggggttcaagcgattctcctgcctcagccttccaagtagctgggattacaggcacccatcaccaagcctggctaatttctgtgttcttagtagagacagggtttcactatattggccaggctgatcgtgaactcctgaccttaagtgatcagcccaccttgaactcccaaagtcctgggattacaggcatgatccaccgtgcctggccaccctgtatatcttaaactagaacaataaagtgaaggatgtaacttttttttgtttggttatttcttccttgtaagcttggacacaaactaaaatggctcatgagtacagctggaagttaactcaagttagaggtctgcaaattatggcccctggactacacctagtccactatcttattctgtaaatagagttttgtcggaaacaacccagtcacattaaaaccaaagcttattcttctatgaattgtctgtggctgattttgtacaacagcagaaaatcacaaaagagaccataaggcatgcaaagaagaaaatacagtctagccccatatagataaagcttgccaacccttcatttaagagatcactcagtgcagatcgtgtattttttcccacatatttccatcttttttgctctttattgtttcttacaccttagatgcacctggaatcattttctctctgtctacagttcatctcttagaatgactttagtgaaagttgtcacaaagacccctctcaacattgttgctctgaaaaagtccgtttttatcagcattcctgaaatgttctctagattataatcattctcttttagtgcattaaagagattattccactattgactgtctgactttgttgctgttgagaagttagccatcagtcaaattcttgctcctttgagggtgatattttgttgctgttcttcacctgtggcctttcttaagatttttttctcagtctttttttcccccagcagtttcaatgtaacatatttagttgcagatttctttttaattatcttgcatgggatttgtgagcttcttgaatctgcagattactgtctttcagatctagaaaattgtcaatcacaatcttttcagatatatcagctgtcctccagtctctcctctccatctgggactcggattacatttcctaaatcttgtgttggtgtcattcatggttagtaatctctctcatgtatagtccatcatgggtcttttaaaattaaactcaagataattgtttgcaagctatcttctcagatacaaagtctgtctttagctgtcttcagtttgttgttaagtctgctcacagagatcttaatttctatgatatatttttccagaagattttttaaaccttctatgtctgtttctatggttccctgtcctctgcagatatcttttagttggtccttcatttatttacacctttcagtgtagttgttttataatcagtatctaattacttattaataaatatctgatgtctttaccttttgctgtggttccgttttccatttctgtccttttctacttgttctcatagtctagcaccttgttgtcatttttgacatgatgaatattctttttgaaaaaaaaaatttagaactaattgacaaacatttttcaaagagaatgttcattgctgcatcaagttcaagacgtggtacagaaaatacatgactaattctaccgaggttctaccacttccattcaccctttgcctgagggcaaactctttagggtctcagtttatcaagaaggagtcttattagacttccaattttaggtgaattctgcattagattttgattccattcccagaaggcctctgctaggaaatcaaataccttcagggaaaaatccgcttttgtaccaagataaatttccaagttttcattattccttcttttcaggcctcaaaatgtcttattgtcttgttgtctgtgtgatgcttttaagaaattattttgtaatatttttatcagcttttttagttgttttcaacaggccagaatgtccctgtaagcagaccctcccattactataaacagtaagccttctgaacaggcattttaacagtaagagtattaggttaagtaaggtcttaaataaaaaccttcctgctaaggtctttgcttcctctgctgcctttgtgagccaaggggaggtttctcactctttaaaactcctgtgggcttaaaggaaggtagccaggcttcgtgctcttttagctccaaactggtacaaagtctgtgttaaaatagccagtcgaggccatttttgtctacatggaactatggttatggcatgtaaccagaatgctaaaaactctttgctggtaacattgtagactgcaaaaatggcaacttggcagctttttgaaaaatgatgtggagtcgatttcttcaccctttcattctggactgctttgcatattacttggttaatacaatgctacagaaaggatgttggatataatctgagtagtctcaagaattttgaggtatatccactcttacttttggaactctgtgaacttcacatctaataaattactggacgatttgagtccatatggaaaggtgccctactcattccagccagtgaacctaccagctaactacagatgcatgagcaatctctctttagatcaactgagaggaaccagtgtggcccagactagaaccactcagtgaaattcacaccagattgccaacctaggaattcgtgagctaaataactggttattgttttaagctactaaatgtagaagaggttaggtttgcagaaaaactcaacacctagagctatattactttatttaaattgttcttcttaaaattaaatctctctcagttatcaaatcaatgagcatttttcagtccttatctaatgagactattttacagtatctgacagtattgattattcgtaaacaatctatactcttttagtgtctatgacactggatctttgtgcttctgctggaatttctgtactattcattcttcatttcccttgtagattttatttcttcttgttttccttataagtatcagcatttgttaggtttccgtctttttcttatgtttccatccacaaactctccctgttggatctcctccacttttttttctatttcaatgaccactttgtataaagatataaattatgtctttatgcaaagcctcttcctgcattaaagtcctgaatatataatctgacagttaggtaatagtcagatatatgtcccgaggccctatgcttcaacatatcccaaagtatgtaactgcgttcttctctgccatctgctggctggctattcctctatttcacatagtatcacaactagtcacccagcaacctactagagaaacctggcataacacatgcctccctcctcattatatttgtgtccactctgtttctctcgcactgctctagtttaggccttccttctctctcttttgaaacattatgatcgtttcttgactagtatccttagctgtagtttgtttctcttatatctattctaaacttagctgtcaaaaaagttattaaacaacaactttcagagcatttgctacagtgaatttggcaaataataaacatatttgctaccacaatttttgtctctgcctctgaaagttatcactaagtgatttctgcaagattttcatggtagcatccaactacacagccagccattgctattggataggagatagctttaaacctgaaatctgtttgccttaggattgtcaaagattaacaaagcgggacagtagttaacatggcagggatatattttaatcagtaatatactactgcaataaggaagaggatctagttctatcacaaacacctcttctaacatccaggttagttttctttcaggtgtctttgtatgaaacatctagagtgggttaggggctatacctttgtgatcctgtcaaacctatatgacatcctatcaatatgaatacgaaacctatatgaatccctattaatatacctgctcacaattttgaggttttctgatgatatttctatttatttcacttggactctgtgaagtcaagtactgtatcttaaatatttttatatccccatcatttagcacagtacgtgacaattaaaatcagtcagtgattttaaaatttaacaacaacaaaaacacataataatgcgctgacctcctacaactctaatagtgcttgtgggctcaacattatctgaaaattgttcatttagccagaattatgatttcaaaataactaaggactataggcaactcattctattgcctcagggaaacgtccaaggtgtcctacttttgtggacatgtgtcatctgacaaaaggttgtcaagttcactgttctttccagttctgcctggtactatgattgcagtgcctaagcagcttgaatttcctgggcaagtgtgcaccatgctgtaataattcagaagctgtttttgtgttcttgaaacatatggtgctagctcagatttatcttgggaaaagctggtcaggaagagaaactgctgaagagctgaaatctctcccagcagctaagaaaacaacggagggacactggcgtccttcctccgagagctcaggctctccgccagtttgtggtccatatgctgaatccagagagctgcttcacttctaataacgattgtgttaagttgtgtgaggctgatattcctccagagggctcacagtttcaagcatacctaaaagcacctgttaggaagcagagcctcagaaaaatgcattagcatttctaggaaaagggcttatttttattcttcttggttacagagttgcaagttggcttgttcagaaagagctgtttttgcaccacactgatgttcagtttggtgcaacatttaagtctgggaagagcacagagccaaatgtggcaagagatggcaatagagaaaatgccaagtgccccctggcttatctcttgtagaagaatttgtagcaaggcttagaccacctgaaatgaatagcattctgcagttctgtctgaatttcactctgtgatttattatttcattatactagactgaatttgaaccaacaaatagttcacccagggaataaaatatacctttactttacagatcctttcccttcccttcccatatctttttcttctttctgtcccacctccaccaatgtgtgtatgtgtatgtgtgagcacgtgtgtgtgtgtgtactcacatccattctaattactggaaacctacctttgctggagcaggttaaatattgcctcttaaatattagtatgtttagaaagcccattcctataataaaagtggtcatttctacccagttgttcccaaatttcaataaattaatctgaataaatgagtttatagatattacacttagaaaatgcatagttaaaaggaaacattttaataaaataacacttttgaaaaagccaaatttcaaactggaaaatcagaagcaggtagtggccagtgccactagaacatgttaggaaatctcaaagtttcccctccccctttaaaaaacagtgttcctcagaaaaagtatacatatctcatttaactcagcctttttagcccagtcctattatagtgctgtttgttccaaactgttttataaaatatgtttatgctaaaatatgtaatattaccttccactaaataaataaatatattgtacacacatcacatacatatgtgccatcaccaactcctatatgaggactaaagctctgattttttatcttggccaaattcctacctaaggggtgtcgggagtcatgccctgcaaaccacaaattctcatcaggtgggtaccctatatatcgtgacttactttccaatctgactctggcataacattatgagacaaggaagaaaatcaaaatatttcaccccaaaacatgtttttctgccatgtcttggaatggccctacaaagccatcctttgttgggaaagatctgcatctgtaaagaatctctgttaacatagctagatctttttctttcaggccctcccaattctgaagagattaactaaaagtctagcaccttttaaagatctgaataggaaacatttgtcatctattgtctctaactgcagccactataagatttcaaaagaactttggtctctacgatcttttatcttaacccgaatatttcttttctatccatctcaggtctttagacaaactcaacccattgtcaaccagaaaatgtttaaatttacccatagcctggaagccaccccccaacccctccctgcttagagagttgtcctgcctttctgaaccaaatcaatgtatttcttttttttttttttttttttgtgacggagtctcccaggctgtcacccaggctggagtgtagtggcgccatctcggctcactgcaagctccgccttccgggttcacaccattctcctgcctcagcctccccagtagctgggactacaggcgcccaccactatgcctggctaattttttgtatttttagtagagacagggtttcaccgtgttatccaggaaggtctcgatctcctgacctcatgacctgctcgcctcggcctcccaaagtgctgggattagggcgtgagccaccgtgcccagccaaatcaatgtatttcttaaatgtatttaattgatgtctcctgcctccctaaaatatataaaaccaagttgtaccccaataaccttgggcacatgtcaggacctcctgagagctgtgtcatgggccgtggtcactcatatttgtctcagaataaatctcttcaaatattttacagggcttgactattttcgtcaacatatactataatatcttccaaaatgtggtcttaactcacgagagcaaacagtgcagagtgtgtgatattttctaattccatgagtattagctggttgcaaaacaagcattctcagcccatggcactgtgtattccaagtcgagcgtattctttaatgtgtttttattttgcttcactctctcatgttaccatttatctcatcttatggtaaagcagttttgatccataatggtatttttaaaagctaaattttccaaactgaaacacctagctgagtaggccgcgagttaaaagagtagtgtggcaatggctgtagattccttcaaggaagtggttgaaggaagggatggattttagggattggttgaagtcctttaatattttcttcagcataaaaaactgactaaatcaattagtacaaatactttccagagcagtggtccttaaactctagcatgcatcagaatcacatggcaggtgactgaaaccacagattgctggccccacctttagggtttctatttaggaagtcaaggtcgtgacctgagactatgtctttctttttctttctttcttttcttttcttttcttttttttttttttttttgacagagtttcactcttgttgcccaggctagagttgcacaggctggagtgcaattggcccaatctcggctcaccgcaacctctgcctcccgggttcaagcgattctcctgcctcagcctctcgagtagctgggattacaggcatgcatcaccacgcccagctaattttgtatttttagtagagatgggggtttctccatgttggtcagtctggtctcaaactcatgacctcaggtcatctgcccacctcggcctcccaaagtgctgggattacaggcatgagtcaccgcacccagccaactctgcctttctaacaagttctcaagttatgcagatgctgtcaggtggtgtcttggttgatttgagccgctgtaacaaaataccatagacttggtggcttataaacacagacctttatttttcacagttctagaggctgggaagcctgggaagtttaagatgaaggctccagaaaattcagtgtctggggagagccctcttcttggtttatagatggtgctttttagctgtgtcctcacacggtggaaggagagacctagctttctccagcctcttttataagggcactaatcccattcatgagggctccactctcatgacctaatcacctcctaaaggccttgcctcctaacaccatcaccttgggtgttagaatttccatatataaattgttaagggacacaaacattcagaccatagcagcaggagggaacacactttgatagctgttcttctagagaaatgtctatagtgcttttcagtctggatttcataagggttactatggtattatctgagaaaaacaaaaatggtgctacctagctaacttccacagaaaaaaatcaaaaacaacttttctttttttcttttattttctcctttttctttgagagacggggtcttgctgggtcacccaggctagaatgcagtggcctgatcatggctcacagcagccttgacctcctgggatcaagggatcctcccacctcagcctcagctgggaatacacatgggcatcaccatgcctgattgatttttttaaaattatctgtagagacaggatctcactgtgttgcccaggctggtctcaaattcctggcctcaagcaaccctcctaccttggcctcccaaagtgccgggattaggattacagctgtgagccactgtgcctgacaaaaaaaaaaaaaaaaaaaccaaaaaacaaaaaaaaccttaaaactaaacaattttttaaaaaatataatgaatttatattaattttatgtttcttttccactgagaaattaggaaaatgtttagtgaacttttagccacatttaactaggaaaaaaacttcttaattttggcctgaattcctggctacagctgactgaccatcccttgacttccacaacctttattgccatcccaggttggcccctcatcctcagagtaacatcctggagagctgtcatcatccaagcttgcctcatatcttctgtcctaaatttttatgcgccaccttctgcccgcaaacttcttgacatcttcagcctgatttcctcttttccttttttttcctcttttatccatttctcagttcattctcttctgctttcattgtttttctgaacatacctagacctcatggtcaatcatcgcattgatcatttctttctaatattagaaatgtcctgactttcttgccattattcttacacacagtcagaataatccaatctaatcattcttttctctttgacttccacataacaatcattgctaggaaaattaatggttagactgccattggaatttccaactgcaaaatgtcctgtctccaagactagatgagcagtaattggacatatccctaatgagcactctgccgttttccacaatgtttatttcggattgtcatcactgaagtccctttctcactaccctctctatcacactttggaaaaagatctttcctcccatactgtacaaataaaataataataatagccaccaatcattttttcccttcaactttcttcacccttccctatcctgctacttgcggattcactcatctgtgcctcattgtttcctgcttcagaagaacacaagagcagaatcaagagccagcacaaacatagttttggaaaagtgcccgattttactttccatattttatcaccagtgtagtgtatgaaaaagtagggaacatttaaaagttcagaaacaagggctgatccattgcagtctgcactttcatgttccatgaaaaccaaaaaatcaaaaaactcactctattgaaatcatctctttcctggtttatctcttaaactaggaaatagttggttcctaggaaatagttggttaaactaggaatagtttggttccctgtgactcttgcctttcatatctatgtctacagcaactcagtatctagtacatcacagggactgcccagtaaatgattcagtgggtcattccttttttttttttcatgtctaatttttgttgatcctcactttgtgatccacaattattcccttttatttttctcttcttgagtgtcacatttgtgttatgttttatttgcttatctattttgacaaatgttcacatctttttaaaatatacatatgtatgagacataaaagtgcaaagaagaattctactcaaccagaagtaacccttgctagtgtgcatttatcatacgacattctggacaaggctctgtgcatatttaaaatgtgtagtccctgggtattcttctggtttctttctgttattacctctcttaatggggtgggaaggagtagataaaattctacctagagtagctatttgaagatgatgcttcaaatattatccccaagtggtgagggttttgtcagggatttggggaggggggtgaggggacttgcacttgcctcgggacagtctaaaattccaatttaggtttgtcatctcaaatacactctcacaagtctgctacgttctccaacttaggggcattgctctgtttagagtttggtttttgtaaaagttaaagaaagaggaaagaaacacaaaaagtggcttaacagtcaaagacaggtttattttggagaacaaacctgagaggggtttctggacgatttttttggtgaggagcactctctcttacggtctaagagtatttattggtgagagaggttggaaagtttctgtgttggggagaagtttatggtggggttggaatgtctctggttagagggcaggttatctggggtctgacatctctctggccggaggggagggttatctcagggctggcatgtctctggtcaggaaggggtttggaatgtttctggtcggagatgtcatttgtggtttatggtcatgctgaccttagccattaggctgataccgtttagatttaggtggtttttgatcaaggtgaactttaaaatggcagtgctcatccaagatggcaatgctcctgctctgtcagttttcagggtgggattgtgactcacaacaatgttctgtgatataaagagatggccattgctttcccaccctcctcattctcttatatccaaccatctccctgtgctaagaagccagatcaaggcaacaccaatggccctccagcaaggttccactgtacgacttcctctcctgttctaccttgtggatttgcatctaaaccttgtctggctcccttcatccctcagaccactttcacacttctaaacttcatccacattttccacagagtcatcacattgtcttttcagattcattcactcacttttagataagtctgtacttgtctgaagtctgaggacataaatatcagctttaatcatcctccatgattttgatccaaatttgagtatgtgatggagatcatttgagttttaggtttgaagttagtttttttgtttttttgttttccaccacataggaaaagttacactctcctcgccttctcccccctcaaccccaacatgtgtctatatgtttagtgacacttaagggaaaaaagtagaagaaaaatggcctagtgctgctatttttcattggccgtccgtcctaccaatttactttgaaatttgtttgaagaatgatgtactgaagaggaaagatgaacaacagcaaaaagtcccttgttagttatgctttgctcacggaagaccctcattttggtgtcctatgacctgcagttcagttccgtttctctcctctgagtgtccatgtttagcccacctgcctctgcattgggctttatagcctatttgttgttgagtagtgaggattacatcttgttagaaatgtaagctgaaaatagtcacagtggagctctagaatcaactttcttggcaaaagtgctaaatagtcatcttgactctggtaagccagggatactattactactaataaccattgcggcctactgagtgcacacaccgtgccaggtagtctgctaagggcttcagtgcattttaatcttttcaccagcccaggactctgttgttttttgtttttttcttaagtaaagaatttttaaaataaagaaactgaacctcagaaagcttagataatttgtgctagttcatcacactaataagtggtagactctctctgtttgactccaatgactatattcttgaacactatccaaatgaataccaaataactcactttgcaaacatttcatgtccattatcacctcattaatttgttcattttattgctcatttccagaatgctcttgccactccttttatcataaaacatcccatccattcttaaagagccagcttatatctaatcttgtatcttatccttcccctaattatccagcataaaatagtgtttctgcctctgttccccataagcgtgtctgttttaacacttatttttaatatatcagttaatgttagacatctatcacctttcggtctcagagttgtaccagttcccatctcctactgtatctggtaaaggacagctttttgttttgattttcagaacttgatttcaatatatatatatgaaaagaggggacaagataaaataaaaaaagtaacatttgatataataatgtctaagtcaaattctaggatttactaggtgtgttatattagaaaatgcaacagggatcactaaacctcaatattgtcttctgaagaaattatcttcataataaaactacttgttttacctttgattgagtttttaagagaaaagcaaatacaataataagtgatgaagtattataactcataatgtgctatgttactgtattttgtcgttgctgataaaaatagttgattgatgactttttaagtgacttttaggcagtctagagtgagcagtaaaagaaattaaagctgaaacagtgaacctaaaattctgttgtagaagttgttaataactgtcttttcttcagcagaagttacctagttctacattgcctctggctttttgccacccattaagataaaaagctagaagataggaactaggaaatagtagagataaggtgaaagtctagcttgaactcagtgaagcaaaccaaaataagcaaagatccctcacttggagatgtggtagaagacttgtgtgaattattacagtgactaactacacagaggaataaagttatacatataaagttaaaagatatgtaatatgagtgctcctgttgaatcagccaacatgaattcagtcatatagtcacaacagtgtgcatcataaaacagtatcataaatagcaatgagttataaatggaattgaccaatatacttagtgagaccaatatacttggtgagaaactacactgtgttattactttgtacaattataaaagataattgcccaatataaataataactaaaatttaagaagaaattttctatttttaatctagattataaaatgaatgatagttatgtaaagtttatctatttttctttggaaggaaaccaaatctggagacataataataatttggtatcatgtaatgcctaggaaatagtacatatctaataaatatttgttgagtgaataaatgaatgacagccactgtaataagttaaaaagtttttgtaggtaaaagacaaggctgaaacaatgattctgactcataagtggtgggccattaattatatacatatatgcagagacacacacataaactttaagaaaataaaattttaggaaaatagataaaatgtcaactagtattttattgttctgctaaatgaatttgttgtcattcatgacagtgtaatgattccatcttgtgtctttgtgtaggcacatgtgtgaaccactttaatccccctctttttaattttctaacattaaaaaaactatttttttgtgtccatgagacatacagtttcaaaattattttatgaaattgaatggatagtataggaattaatgtcatgtatatcacagtgtgattccttttaaaactgaatgagaggaagttaaggcatgcctactggttttcaggggcatctagtaactttgagttattaagtaatgaaatgtgagtgacggagttcaagttcctattaaacataaggagaaaaacattcatatagtaggtttaatcactgttactttacactttgatgtgcaaattaaaatcgagaacgtgtcatttaagtaggcttaagagttattcagaggtagaaatatgacagcagctgacctttattgttatattttactgcaacaaaagctctgtggatgttacgcagtttctagtgtgaattgtctgaaggtgataaaagaattcaaatatctggactgaggtatatattttaggagatagaaaaatcactttcttaccttcggcaaactttctcattgatcacaagagtcaaagggcaatcttcaatcctctaacttacatcacatggtaaactacttcctttgcaatccataaaatgaaaggtacaggtgatattctgcaaatacaataagaagattctgttgggttacgagcgtcttgtctgattaatttttacattccctggacctaaaataatacctgttttgaaacagtagctccatgagtatttaccgaggtcagcagaatttcattaactgaatttaaatgtagtaattgaattacccacacaagtaatttagtttgagtagttttacttagctaatagtggcaagcataacattaaaatgggcaaagaaataagcataccagagttctgcaagcattttctataaacagccagataataagtattttaacttacgagggtttaaaaataaaattaaggatattatgtaggtgcatacataacaatttaaaatgtaacaatttaaaaacaaaacaaaactatttgtaactcacaagccatacaaaaacagacaactggcactttggctagtgggctacagtttgcccttccctgaaacagatttttgtgcaataaattcaaagattttgttcccgtagttgacctaaataattctgtagatttggtcctccatgatgcaaatttacatagacaaggtgattagacagatgatggattgaaatcaatttcttgtgagttaaattaaacaattgaaatgaattgttttattatgcctttgtctctgcatataagttagcaaattctgggagccaagtggaaaatgtggataaaaggatttaagcatgtctggagcccctagggagaatggcatctttggaagaaaaaagttagtggagttcaaagtgtgccttagaaaaggatagatttagatagaagatctcatccctggtaacaggaggaaggtcatatgcagatgggctttgggaggagtgtgagggtgagttagttggagcaggtgagggcagtggagctcactctactaacctggcagaacactgtggtcctcaaggcctgatgtaagtgcatttagctctgggagacattagacacaagtaagatctattcaggaaaatgttattacttgttcccaaaaggaattctgcaattctgtttggttttttttttgttttttttttttgatacggagtctcactctgtctcccaggctggaatgcagtggcactatcttggctcactgcaacctctaccacttgggttcaaacagaaattctgcacttctaactgaacaaaatatgcaattaaatacacatgagcaatggaaataaattaactttagtcaattcatttctgtagttaaataacagtagtttatggaaaattagtattgccttatcaaaggagccaaaagccattttcaagactgtaaaacattttatatgtagtagtattaagtggtgtaatagtaaaatttaaaagaaaaacaaacaaacaaaaagaagatgagcaagcctcttgatctttctgaattttagcttcttcatgggtagggtgaagatgtgttacttaatgtttgccaatgtcttatctatctttacaatgccaagaagtcataaaatttttatgttaaatatctaaagtataaaattactctccaaactacccaaggtacacatgtatgtactcatgcaacacttagacccatagttcccaaactatgtgtcaaagtgccttagggagctttaggcttgtgggtcatacaatttcttacaaaataactcaactctgtagccctaaagcagacgtaaataatatgcaaacacatgagcatagctgtgttttgacaaagctttattttcaaaaagaagtggccaacacccaagctgtacttcactgaactctggtatacagtatatacatatatatttatatatgcacattaaatatatgcgttgatatgcgttcaagcaatgtacaaatatatgaagtttcctaattgatgaataaaatgataaacacataaatacttaagtgaagaatggagagaaggaagacagtaggtagattagagatagcctgagtcaaaaggaataaaagccactagtcagggaaaagagcttaatacattcatatacatatacacatacatatacacacagatgctcctcaattttacaatagggttttatcccaataaacccctcataatttgaacatatgatgggcttatcaggagagaaccccatcataaatcaagaagtatactaaatgcatacacttttgtaccattttaaagttggcaaatatatgttgaaccttcctaagttggaaaatggtctatctatacatgtatgtacttgtatatttgttctctgttcctctatgaaatattgatgacaaatttgttatttatttgtcgtaacagttcgtctcagatgtgatagatacacagtgtgtatgattatgaaacttgtaaaaagttttaagaataaataaatcaataaacatccatttcaatcctgatagtaatgaagtttaaactcatttccttggtactgtctcttaaaaatagtaataaaaggttttgcttgagcagaatgactgcctaatgtagacattacactcttgtgaaaataaccactttgataatacaaagatagccagtctggtagagattaaactgagacagctaagcacctgtgttgcagacattcagttggccatgttatcaagacccaagatattgtaacaaataaataaagtcatagtagtaataataataaagctaatcaggccaacagaatgccccccaaatttatttccacttaataaatgctcttctaacctcatattaaaaattgtgtctctgattccagttaaagaccaaattttaaaaatacagagactccaaatctgattctgtattgaattctaatgtgaagatctttgctggaatgcttcaaaggagattagaaatattgattatcatttaagtactcttagatcaccaaaatctcactaatgaagaatttctttatatcatgactgtgattggctagttaacaaactataaaatgaacatgtaatacattaatccctcaataacatgacctggaatccctacattctaaaaatatctctttgttttctgcctgtatttgacagaaatacggcattaatgaaatgttcagttcttgcttaaagtacataccggcataatttttcaaggaatgtagggcttcaacacttcttaaaagtcaagtttgactcttcctaggatagaatatagaggtatgattaggtaaccttaagtgagagagagattgcacgtagaaaataaagcttattctgccacctagaacagttttttgaatagtccttgttatgtctgaatcttgtcactcaggtctcagttgaaatactagctttctacagagatcactttttgatcactgttttaggaaggggtctttagaaattagattttgggacagaaatgggtatgtaggaagcttactggaaattgccttggaattaacacctgtagtggggtgaaggaacctggactggcagagaaatgtagtcaaaattaaggccacagcagattcatctttttcaccaggagctctggtgctggaatgcatctgtagaattattccaactttccccagaggagtaggcattcatgtccccatatcagtcagccattggatgagggatgggtgcacacgcatggttgtcttacctctccttggctgaggacaattcccagagcaaggctctgactgagagctttcagccaaaaacactcccagaagttgggggagtaacagcttcagtcctaatgagagaaatagatggtttaaaatggcatctgcaacattctactccctgcactattcagatacttgtgattcatatacagtcatgcatcccttaccaacagggatacattctgagaaatgggtccttatatgatttcatcattgtacgaacatcatagagcatacttacggaaacctagactgtatagcctactacacacctagggtatatggtatagtctactgctcctgggctacaaacctgtacgacatgttattgtattgaatattgtagtcaattgtcacacaatggtatttgtgaatctaaacattaaaaaaaaggtacagtaaaaattcagtactataatcttacggcaccaccattgtataggcggcccatcatttatcaaaacgtcattatgcggtgcatgagtgtattaagttctggaatcagctcctctagaatccctggaaaaacacaaaaaggacagtaaatgagacaaactacagcccatgcactatagctagtcagaagtcataaatgatattcattgtttctctcttccattatgatttctagattcacctttaactagtgcttctgaagatctgggtagctactaaatgcagaatgtcatatctgcagggtctgggttcttagtcatcataaacttctcaggccttacctgtttctcttgtccagttaccacaaaaatttagcaacagagaacaaagagatgcctcaagaatcaccaggtttaggccaggcacagtggctcatgcctgtaatcctagcactttgggaggccaaggcgggcggatcacttgaggtcaggagttcaaaaccagcctggccaagatggcaaaaccccatctctgctaaaaatacaaaaaaaaaaaaaaaagaaaaaaagaaaagaaaaatagctggacgtggtggtgggtgcctgtaatcccagctactcaggaggctgaggcaggagaatcacttgaacccaggaggcggaggttgctgcgagccaaggttgtgccactgcactccagcatgggcgacagaacaagactccatctaaacaacaacaaagaatcaccaggtttattatatgggggccatgcaaattcttccttgtccccattgtgaaacagcagccatactttctcccggtgatcaaggtagcatctccaggatgactatcactttatttgtctcctggagaactggtatgagaaggtccaagtgacaaggtagcagctatagcttaaatgttaatggggcttttgtggcccctcaaggtcaaggacctttaaacctctagaaccaagaactgtaaggacagaaagcatagattcctaggagttcaaggcagtgagctatgagtcactggaagtaatgatacacagagccattacttagctcacatattcatgtattatactgttgaggatgtactcatacacaatggtccctcatgtagagtgcatgctgtctcctggaggatgggtcccctcagtgtgttatttccaagatggtgtctctgttgtgcctttacaaggatcttcttttgctctgtaaggctggcagcttctgagtgttgtagggtgtgacagagccagtggatcccatggatatctgccacatctcctttgctgcagtgtgaattacttggttcaataagatctaacatatgacataaatgttgatgtagtaagcagtctttagtccattgtacaatggttctgacagagaccctgtgagtagaaaaggcaaatctattcttggttatatggatgatgccactcaagatgaatttctgctctttccagagtgaaaaatatttaatacaatgaacgtgccaccaagtggctggttggtcttctgaaaagatgatgtcatatgggaggtagagaacttgtctctgttggctgcatgcagtggttcacacctgtaatccaagcactttgggaggccaaggcaagaggatcacttgacatgagttcgaggccagcctgggcaacagggcaacaaagatcctgtctctataaacacccttaaagaaattggccatgcatggtggcacatgcctgtagtcctagctacttgggaggctgaggtgggaggattgcttgaacccaggagtttgaggctgcagtgagttataatcttgccacaggactttagccgctgagtgacagaatgtgaccacgtctaaattaaaaaacacacacacacacacacacatatgaaatatatataaaggaatatataagaattatatatatacacacatatatttgtatatacgtatgtgtgtatgtacatgtgtgtgtgtatgtgtgtgtgtgtgtatatatgtatcaattggtctctgttattggcagcttaggtatccaaagtggcggtaactaagatggcatatgaaatatgctgactgacatgaactggctaacttaacttggatgatcactgcctcttttaagttgctcttgggggagtattaacctgtgacacaaagatgttcacaaattatgatcattcccatagatccatccacatatctaatttccatatctcctttttctcagtcataatgtttatccttccaggcccctgaacaattagtcaattcaccacagtccatgagtctgtaaacatccttatcttgggccacttttctttccacaccaaatggaaaactgcatcacttgcagctctcaccactgggagaacttattcttacagttgttttttagggtcacttttagtttttacccacatgctgagccaactcccctgtgaaccaagctcagtcactttcctgctcggcccaccagtcatatttgtcctcatcacgcagccacaggtatgtgctgtgggagggattttgatgtaatagtgatggatgacatggagtctgggctacctgattacacatcatagttgtgccctctatttctgctcttgctcaatcccaggtgtgcaattccatcttttgatggatttcttctgcacctaccccaccttatggctggatgagactctcagaaattcatgatggaaatatctggttacaaaatcacttgatatctcgtggttggctgacacatatctcctaataactgcttttggtatatagtataattctccagtgaggtggcatgatcttggaccagaactctaggggtgtacattgtgattctcctgtcagagtttgccataaactctgcattctttcctaccactgatatatgtaataatatgttatcttttggatcatacggcccaagtagggaagccactttctcctacaccccctacgaagcatttttcctcactagttttcactgaaaacaggcagcctttgctgtcacacactaatgggtagaatgagtattctcaagtgtgaaacatgctgtctttagaatccaaagtagtgctgcactttgtcttttaatttgattggattgtttcaacatgccaaagataactggactcctaaaaacatcactgctgtggttggcccttaaatcttcatggggtttatttacactttctaggccacacatgtttttccaaggcctctaacgcacttgcaacgtcttgctactctagttcagttaatacgaggttatcaatacagtggaccaatttgcaaaatatttgggtacctgaaccaattctgcaaattagttacatggtccagatttcttctgactaattatgaataggagaaatgaggaagttaacatagagttacataaaaaagtaaacgtacagtgggaagtattagtctgctagggctgctataacaaaatattataaactgagtgacttacacaacagacatttattttctcacagttccggaggctggagagtccaagatcaagatattggttcctggtgagggcttccttcctggcttgcagacagctgccttctcactgtgtcctcacagggcagagagagtgatagagagctctggtccctctttctcttctttcactcacaggggctccaaccctcatgaccatatataaacctaattacctctcaaaggcctcacctccaaataccatcatttttagggttagagtttcaaaatatgaatttgggggaacattaacattcagttaataacatgggggaggggttttttgtttgtttgtttgtttgtttgtttgtttttgagatagggtctcactctgtcgcccagtctggagtgcagtgatgtaaacttggctcactgcaacctccacctcccaagtttaagtgattctcctgcctcagcctcccaagtagctgggactacaggtgcctgccaccacgcccggctaatttttgtatttttagtagagacgaggtttcaccatattggccaggctggtcttgaacttgggactttgtgatccacccgcctcggcctcccaaggtgccgggattagaggcgtgagccaccacgcccggccatgggggagttttggtacagatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttgggttattctccttcagacaatgattctgattctctctttttttttttttttttttttgagacggagtctcactgtgtcgcccaggctggagtgcagtggcgcaatctcggctcactgcaagctccccctcccgggttcatgccattctcctgcctcagcctccaaagtagctgggactacaggcacctgccaccacgcccggctaatttttttgtacttttagtacaggcggggtttcaccatgttagccaggatggccgcgatctcctgacctcgggatccgcctgcctcagcctcccaaagtgctgggattacaggcgtgggcaaccacgcctggcctcagacaatgattcttgaaccaagtcttctttcagattttggctccaccatctccaaaacttggtttccagagttaacttggatatcacctcaatttctaattttaggaaatgagaaaggaatatagatgattatgcatgggaagtttttaatggagaaagcctaaaactaggttgtatggttactcttaactgcaaaagagaattcaaaatcgtttttccatgaagaatcagaaaggggaatgactttattccctctacctagaatagtgcctgactgatagcaaaaattcaatgtataaccatttaatatatgaataaattagtttgctttgctctgcttcccaaccaggaatgtactggttgataattacttatccaaaatgcttaggaccagaagtgttttggatttcatattttttcagatgctttaatatttgcatatactgtacctaatgagatatctttggaatagaacccaagtctgaaatttatttctgtttcatatacaccttaacacacagcctggaggtgattttatacaatatcttatacaatatttaaaataattttgtatgtgaaacaaagtttgtattaagtatttatacatggaattttccatttgtggtgtcatgttggtgctttaaaattttcagattttggagcatgtcaaatacatatgtcttttttttttttttttttttttttgtaagagacagggtcttgctctgttgcccaggctggagtactgtggcatgaccatagctcactgcagccttgacctcctgagctcaagcaatcctcctgcctaagcctcctgagtggctggatctacagaagctgccaccacacctggctatagacctaaacatatgtcttgcaaatgtttcacatgaccatagagtgagatattacttacatccatgaaaattctgagttctagagaaacaattcaaatggtgctgtttattattgattgattcataatttcatttatatataggcagtagcaatctgtctacagcctccttagtgataatatatgtgatcttccttgttccttcacactgagtaaggtttcatccctgttttttgtaagaggtagtctgtgttttttcctttgccaataactcagtgagagaccactgccctccaatataacatcaaaagtacctgatcaactaagtcaaaaatttacttgatcttctcttatgttatgtaggaaaaaaaatctgttttggccaggcgcggtggctcatgcctataatcccagtgctctgggaggccgaggcgggtggatcacgaggtcaagagattgagaccatcctggccaacatggtgaaaccccatctgtactaaaaatacaaaaattagccgggcgtggaggcacgcacctgtagtcccagctacttgggaggctgaggcaggagaattgcttgaacccaggagccagaggttgcagtgagccaagatggtgccactggactccagcctgggcgacagaacaagactccgtctcaaaaaaaaaaaaaatctgttttataaaatcaacgtttgcttgaattgattgaatttccccatggttacaaggaaataacctagtttgccaaagatgactcacagagtttatactttaccgtttgtctttagcacatactcatatctaggtctacctctctattgattattcttccttaaaatctttttctctgagatgattatgtcatgattttacacatccacatgtatattagtctgttttgcattgctataaaggaatacctgagactggtaatttataaaggaaagaggcttatttggctcatggttctgcaagctgtccaagaagcatggtgctagcatctgcttctggtgaaggcttcaaggagcttacactcataggaaaggaaaaaggggagcagatgtgtcacatggtgagagagagagagagagagagagagagagagagaggagaagcaggactgacttttttgagcaatcagatttgatggtaactaacagaccaagaattcattcattaccatggtgacagcaccaagtcattcatgaggagtctgccccgatgacccagacatctcccacttggccctatatccaacactggggatcacatttcaacatgaaatttggaggggacaaataccaaactatatcaatatgattctgcacatgaaatgggttagcatagttagagataattaactaggctccaagtctattaagttaatataaatcctaggcaaataaattatttatattttctaacaaaatatgtattgaagctaagcaggcacatctgatgaatcattcactcttttgtttgttgtttctttttaattacacaaattttcagtgattatattgaaaatcatgcaggcaaaagacttcgaataaacaaatgaaagttcttaaaagaaatgttacatcctaatggcaacacaaaccttctaatttttattttttaatgtaacttagaggctttaagtcacaggtcagattaacttctgatgtaacccagctatgcagactgtttcctactactgaagacatgaacatacatagaatttccatcacctaaaactgttttggcatcattgtgatggcctactgtacttttgcaaattactttatcatccttgctgctttgctattcttcttgtcaatgccatgtctctgataatgtcactttgaacagtgattgtgtgaatgctcagaattactaataatttccacagacagtatcttgtagtgaggtagtaacagaatatttttccattctgtgtcagtgtcttacaggactgattttttacaagatggctttcttggcatccaatgcaaggactctcaccccaagagaaaactttatgcacgaattagaaatgagggaataaagtttcttaaactaggactgcatcagaagatgtgttctctctgtctctgtttttttgtttgtttgttttttgtttattgagacaggggtcatgcttcgtcatccaaactgaagtgcagtggtgtgaacatggctgatttgcagcctcaatttcccaggctcaagcgatcctcctacctcagctccccgagtagctgggactacagcgcatgccaccacacccagctaattttacatttttttttcttgagacaagagttttgccttgttgcccaggtctgatctagtcctgagctcaagcaatccttccaccccagcttcccaaagttctgggattacaggcctgagccactgcacccagcctgatgtgtactctcttaaaacgttcttaaaccgggccgggcgcggtggctcacgcctgtgatcccagcactttgggaggccgaggcgggtggatcatgaggtcaggagatcgagaccatcctggccaacaaggtgaaaccccatctctactaaaaatacaaaaaattagccaggcgtggtggcaggtgcctgtagtcccagctactcgggagactgaggcaggagaatgacgtgaacccgggaggcggagcttgcagtgagctgagatcgagccactgcactccagcctgggcgacagagctaggctctgtctcaaaaaaaaaaaaaaaagttcttaaaccaacaattttctataatcactaattaatgatgatcatcataacttcaaccacggtatttttaaaagagatatttaagagacttttcccctgataatttttatattacttaatttgtgtattataacatgaagggaatagggatcaccgatttgacagtctattgttcagtctaattaagtatatacaaaactgaatttccttaaaatactgaaactcaaggattaaaaataaattgtttagtaagagaaaggagaaacaagaaagccgatgggaaagacaataaagaaggaacaataaaaagtttgtgggattggttatagcttttttttttttttttttttttttttttggtgctagccataagatttatcatatgtcagataactagaaaatcaaagcctatattttaaaatccaggagccaaaatttcgacagctgttttttaaacaatgactcagattagctagctagctaggtaggtaggtagataaatagaagatagatagataggtataggtataacaaaatctttttcaatttacatcacgagtatcttatgcattaccatcttattataaatgcaaaatgtactttaaaatgctaattttgagaaagataatgactaaggcaattttatagtacttgtgatttgttccgttagtatattactattacaatttcgaaagacttatagaacatttttagtcagtctttttaagaaaacctgaatgtgcaaaatttaaaacaagacattatcttttataaaagaatatattaatataatctcatctttgtttgaagggaaaagacatcaaataacctttatttttttccaaattcatgaatttatacatatttgatcagtataagtttttgagattacttcacataaaattaatcttttcagaattattgctgttaatttgatcacccagaataccagtgatttactcacccttttcatggtactggttttcactttcaccagcttacttttctgggtgatatatggaccctccatagatatttacccctagaaaagaatctacctattcctaatatgtatgtatctcaacttacatagatgaaatatgcagggaaaggagattgtggatttgtaaatctggagtagaatttaaaaaatcactgcacagatagaccaaagtttgcaaactcagatgccagcagaggtttggtaggtaatatacaagaattgaacagccatatataaaccaatatattggggtgaatttgaaagcctacgccccacgcaaaaagagagcacattatctacaaagctcaagcaaattatttccttgctgaatgtaaaatctatctttccaacatagaagaagtcagaaatccaattctttatgtcaactcagtctcagttaaatgcaggtaagcaatttgaattactgtattaaacaatgtacaaatcatacaaaacaaatctcttggagacatttggcctaccagtaagccaatttaaaacctgtgtggggatctagtgcaggaattacagattttctataaccaaagtctgaaaaaaaaatttaaattgaattttagcttcatccaacatagccactttttctaccattacctattatttcattcctgttagctttaatcatttacctgcttgcaggtcctgaatgaccttgagattgtaactaatgttggtccaaaaatctcactgacaatgttattgcggcatgatcagtgaaagagaagttgggttcatggttgagaaacagggatgagaaatataggagactggttgaatggaggtatggtggaactatgacaatgcccctgctgtatcagatgtggcccctgctgtatcagatgtggcacctcctcatccatttgagcagccatagctatgtagaaaaatcctgaatttatgtcattaaagatgtttgatgttaacataaactgatcatttataaagtaaataatagggatttggcgtgtgtgtgtctggccttgtcagaagtaaacaaggagaatattcataatcttactcaagtcatctggggaaggattgccccttgtagtaatacttttctggaaaacaaagaggtttggggatttcttaaccctaatgctttctagaatctcagggttcagttaaaactcaacattggcggccaggcatggtggctcacgcgtgtaatcccagcagtttgggaggccgaggtgggcagatcacgacgtcaggagatcgagaccatcctggccaacatggtgaaaccccatctctactaaaatacaaaaaattagctgggcgtggtggcgggcgcctgtagtcccagctactctggaggctgaggcaggagaatcgcttgaaacaaggaggcggaggttgcagtgagctgagattgctctactgcactccagcctggcaacagagcgagactccgtctcaaaaaaaaaagaaaaaaaaattcaacgttgtcaataaatatctgatggtgacgtacaaagaaaaagctagagagaatttcagtttaaagaattgtaagttctattaaggagatattttttaacacagctcaaggaaatattatccattcctggaatacagtggctctcaattggaggtgattccttcacgctgaatccttggggacacctggcagcatatttggttgtcacaaatgaatgtggaaatgtgactggtatcaattggatagaggccggactttacactaaacatcctacaattaacagagccccccgcaagaaagaattattcaccctaaactttcaacaatgctgagcttgagagactttgctgtagggacaaaaacacaagtttgagaatttgataattctctgccatcttcaagctacatggattcccataagtaacttagcaagtatgagcctcagttttctaatatggtagttgggcaaaataaaatatatcaaagaacttgtgaggattagtgaagtaaactctgtgtaaacacctaccacagcgcctggcaaaaaagtcaggaagaaaataataattacctctcgatttcccaccctcctttacatcgacttctcacttcagtttctccagactaactttttggtgatcaaccatttcatagtgatgacgaggaaagtctaaaaattctgggtttggaagtaagaaaaaatcagagcttttgtaccaccaggatcagttttatgatcttaggcaaaccaacttagtctccgtgttttagttttcttatctgtcaaaaggacaaaaagacattttcccttgcctgtcttggagatgaaaataaatgaattactaggaaaaggagcaattttcccaggagaagtgatctataaatgacttgtgctttagcagtgtatgaaagcactttgagaagtatggacattatctaaattaaaggatttaagttattttactataagttacattatttaaatataatgtatttaaatagttttttgatgtgtgctatttattttttaagttatattttaaattagagaactatctatagcattaaaatatatatagatgagtctcagattaagactataaaatttctcacataccaatacacatttcatctctgaatagtctttcttttcatattttctcagttttgtttcttcaggtagttttctttatacagtttaaataaatattttgatttttttcccctgatttactagctttagatagtatcattttattttacttttcaaaagtttaatgacatagtgacttacccaaccatatgttctctttcctttcctggagcttgtttatattggtattttaaatttgtaaagtttacaaatttcacatttaatatgtagctaaaattgtgctctagctttactataggttgattttaaaaatataagcacaataaaaacgacatttatgatttcaaaattatgtgaatatgcaaaccaaatactgaaattgaaactgtggagaaggaaacgcaatcctatggcactaaagttctaatgctcaaaagataatgtcccaagcatacacaagtagtagcttttcctttcttatgtgcttatgttttctccacacatcttcggtgaccactaactcatgttcataatcatcctctcactttctttcttgaaggtgtttttgcttttttttttttttaaattacgttgtatagctttttaatgctcattggtttcccagtaagcagactctgaaacaaagatttgtgttcaggaaattgataggacattgattggattttgttcctaaggatcaacttggtgggggataaggggagacaaagtgagattaaacaggggagcaagattgagtaaaagaaaaagctggcctgtggaacactcataacaaaggcctcaactgatttcacagggaatctcttgggtggagatgcccctttgtcattgttccagctgccacaagggagtaggcatggggtgtaggttccacccaggaggcggtgtgatcttgggcaaggtgactctcgtcaaccaggacaatattgggatggtgggtggagaggaactcagctgcaaactttcagccaccaatactcccagcagctgggggaaggcaagcttcaggcctgaaatatgtgacagagcagggaaaaattcaggccacatgtaataggatccatccagagcaatcctcaagaggtagatttctcacgagatccttgaacatttggaaaactgggtttagttttttcattatccttcactggtaagttaatgaaaagtagaaataattttcctcaaagtgtttcttcattgtctttttagtactcagtgtctgatgggaagtcaagcggccaatcagattcctgctgtgtggtgtacatgttttactttttctctctatggaagattgaggaaagtttccctatcctgggagttctgaaacttcacaggatttggagctttttaaaattctaatcagcctttgtatgtttttaataagaagatgtgccttcccttctctgaagataatctttttctaatttatttccttgtttctttcattcactatcacagttcttttcacctggaactcttgttagataaaatccagaatattgtatattttttccattaaaataatcttttcctttattattcttccctttgtcttttcttctttttgtttcctgggacattttctcaagttttatcatccagatcatcagctagatccttaggtatattcattttcctttccgttctataaagtaacattaaaaatttttattttacattatttttcttttacttctttttatatggtttctttataaacatttattgttattttaattgacaaaatttgtatatatttatcatgtacaacaagttgctttgaaattctgtatgtatacattgttgaatggctaactcctgctaattaacatatgtgttacctctcacacttaccattttttctgataagaatatctaaaatccatcctctcagcagttttcaaaaatataatacattgttattaatacatactgcatgatctcacttatatgtgaaatcaagaaaaaagttgaattcatgaaagtaaagagtaaaatggtggttaccagaggctgaggtagcggggaggtgttggccaaaggatacaaaatttcagttaggggaaatatgttcaagagatctactgtacaatttggcgactatagttaataattctcttttattttggcagcattctcttcttttatgaatacaagtgcttgcttttctcttaagtctgtgctgtagataatttctacctctgctttagtcagccatatgcttccccattctggtattttcgttcacatttggttcatatgtttggtggtctatgagtcattatttcatgaataaaaacacaactagtttaattgatataagttgtttgcataggtttactctgcagatacataggtctggttcccaaagtgactaagttacgtgtgtgtgtgtggtatatttgtgtgtgttgtgtcagtctggactaaattttatataatcataacatgtaatattatatatcaacatatataaaatatataacacatacaatatatgctgtattttggtgtttgttttgtatgttttacttgttatatataccatatattatgtttcatatgttgtatatatgctatatatatatatacataatgtgggtatatttaaatgtgtctatatgtgctttttaaagtctaaatgttccaaatggttcttttgcccccaaatgtgtcttctgttagccttaaattctcattattttaaatattttcatgaagtatatcttagacacgttttttgctcttttttgcccataagaatcctcctccccagtcccaccccttggcccaaggaaaacacttctaatctgattagtgtgaagtcaaacaatagtgaattcgtactcactagcgtgcagattgagtatgcattaaatcatacatgtccattttctctgtctccttggtacttacataaaggtggaagaggactaggtttccagtattcgccatattatgcttcatctcctctccacttccttcatctatgtgaaaagtccaagaataataaacccttgagatacatattttggggcaacatataacgttctacataggctgctcaaaactggagtttacaagagcggtgtattaagatatcaagaacttgtgcaacccttaatattatgttttggttcttatttagctgttattctttttgtgtattgccctattgaaaactgttataattgatcatacacattgagtcattcttgtcatatccaaactgaaacagagtctagaagctgggggaaaagcactcagcttataaaacattcctccaagaatgtaattctctgcaagtctgactactaaaattgcttgttgtaacccgaaaccagttttatctacagcttctgagatgacttgctgcaatgctaggactaattctgcccaccaccattgctcaccaatacgaacttgccagctccccaaacacttactagtgtcagcgaactttctcaaagaacagtatataacatatctccttttttataaaacctctagccttctctttgttctttggacctccagaatacccccagtccatgtgtatgcctcaaactgcaattgtttcttcacaaacaaaacattaaatttggagatttatctttacatatttattctgactttgaaaagacatagaaaaagagaaagtatatgagcatgcatttgatttaataaaagtctcactcctaattcctaattcctagtcatgcccattcaagcattctactatgtctgcatgaatccatttaaaacagtaaatattaatgaagaaaaaattctcatttatcaattagcacccaccaatatttattctcaaggagttatattcacgatctagattctctacatgtgccaccaaacaccccacttttaccgctcctcattctgctcaggctcctgcattcaagttctaactccacttacctttgtctctctaggagaaagtaaacacacattctaacgcaagtgagtattttttggtactgataacattgaaaaatgtccaattcaaaatataaaatttctttcacatcattttatgtcacactagtaagaaatactagaattagtaacaaattacttttcgcctgcctctattctgattgtaacttaccaatgtgtttctacttcgagattgagaagtatagcattaacacgttggaattaattccctggtttaactagaaaactgccaacaagggaagtgggacataaatagtttgataagaataaagaaaatccaaagcgttacactgcctgcaaaatgaacaggtacctgtacctgttcacaaagtgaacaggtgagcagtcatagggcactatgctggttcattgcctaagacggcacaggtaggcttgtctatgtgtatgaccgatatgtgtgtgcacatatccgatatgtgtgtgcacatcggagacctacggggaggtttgcaggaggtgttatagaaaacggttgtttcttcatcattttgccaagagctcttgtcctccaacctaactgtgtccatacacagtggagcattatttgagtaaatgactgagctctgggaaatgggtaaatgaccccaaggcagaaaggtgtaaataggcttgcctgggcttctgtgtgtgttactctgctgctgtgacaaccattgctagcataacaataagatccagggttacctttatggttgtgttgagttgttggggaaaaattagaagagaatttggatcatctattctcaggagacccgtttgaatcatcaaagcttaatgtcacttgtctctatctctttcaaccatgcattccacacaccaatttgcttaaatagtggatgcacatgccaaatctaattatcccttatctcacaaagtcattaatcattcccatccattattcattgactaccaatagctactccaatctttagtacatgcaacttcagtgcacattacaataccctgtttataagtggcatttatctctgaaacgtaccgcatggcatttttaagttagatgaaatattcctggcataaaaactggtggtgtgttttatggtgttcttctcgtaatccataaaattagtaatataaaaagaaaatgctcaagataattgtgaagctgcagataattattcatggtgatgttaattagcacagtgttgtgaaaatggtgcacaacctacacagtattcagggatcgcaaagtactttgaaaagaggttgtatattatccaaaaaaagcagaaggaaagtggtgtgagggatagattagcctagttaaaagacaaaaacaatgtgaaatttggggtaactgaagcattctctagccatttaatattctcaactgctgcatactacacaattcatattgtcccacatatactttaaccttttgatttcctctaaaatatttgaggggtacttaaatagacacaatgattaagttcaaatctcattttttttcccaaagacacttacacagtctatgggacagcagagatttgaacacagatctcttgatggcaacccagagctatttcgttaatggatttattggatgaaaccaagtttttttcagtgccttctacataacaagttactatacacagtgccattacatagcattttcagaagtctattgaaaacgctaattatttatctatctttatatctatattttcatctataacctctatttatcatctatcatctttatttatagatgagaaaattgagagtcatcaaggttatgtatttttcccaagcttcctagttaataaataggtctgccatgatcctaatcttaatttatcagattcaaactgtgatgtgcatatttccaagactaccttttgttagtttcctgtcttgctggcaagtaggaaggacttattctttctttataataaaaatgttaagtttcaaagattccatagagaaaaccttgtccaagccacttattttaaagataagaaaactgagactcagaaaaggtacttctttacacatatataattgttgtaaactttaggtaaagcacgcatttcctaactattgatcttattggtatattttctataacattatgctttcctcttgagaggctcacaattggaatgtcatacaatcttttcctcttgtattttctctctttctagttaaaatcaatacataatgtaacattgagctcaaaaccttcatcttccataaatttttatcagatttcttgtgcacaaagaatttatcttttcttggaactaatagaacatatatatgattcaattaatcttttccatttgctgtatctttttatttattctgcctcataatcactcatagtttcttaaacatgttcatatcttatcccatgagctagatgacaaagttctgtgagaaaaactcgtacacttcctgtttctacactcttcctgttgtattgccttgccatggtaagcactcaattagtatctggtgattgcttgcttaatgtttgaccaggacaaagagtagattatttagcctattttatttacaaggtacagcaagttaaatgatatgtggttttatcattaaaaagtgaaaagggaattaaggagattgaaaattcactgcaatgttctgcctgctaccatgatggtggaaagccaaaacagcaattttaccagccagcttttcctgtggtgtgtttctacaccaatgagctcagtattttaacataaactgtataaaaataactgctagtatttatacttcaaaatgtatctatttagttgagtgtgatggtgttcacctataaccccagccactcgagaggatgagttggtaggagcacttgagtccaggatttcaaggctgcaatgagctcagacagcaccactgcactcccgcctgggtgacagtgtgagagcctgtctctaaaaagaaaaatcaaagtgtctgtatttctcatatttcatcacacttttggagtactgacttgtacatagatttctgaaaacgctttgtaagctgaacataagacaaaaagaagatgatgagaaccagccttatcttcttgaaaataattacgaagctataaaaagaaacagatacaactagacaaggaaccttaagggtcggggaggggaggaaatacttggatgccctctcttccttctggtcctcttctatgtgtattgattgcctcagacaccttcagagtaatcatattgtggagagcatggatgaacatctaagagggagaaaatatcaggatattaagtaaaactaggttttcaaatgcaataaccactcactgtagcttttcggggatgatatttgcctggcaataacttttgatttaagaaaaatctttttcaccaaaacctatcccttctctgagatgggttccaatctagataaatggcaaagctattctcctgtttactcaagacccaaacctagatgttactgttgatccctttctctcccttacctactatagccaatcaatcaccaatttctgctgagtctactcccaaatatttcttgagtctttccatttctttccaatctgttactatcactgtagtctgaaccaatattatcttttacctagaccatttatttactccaaagtaatttctatcactatcgaccaccaaataagtgtggaagttaacagtgccagctttcaagtcagactgctcactggttagctaagcaatattaggcaatttttaaagctttttgtaagatgaagataataatatttaccttgttaccagcagcaaatgggtctgcagcactcaatacttgcctaactggaggaaaaaatttggctgagggccagaagtaggttgaaggcaaagggagagataaaggcaagtttgtttttttgttttgttttttgtttcttgttttggagacggggtctcactctgtcactcaggctggagtgcagtagtgcaatctctcagctcactacaatctctgtctcctgggttcaagcaattctcctgcctcagtctcccaagtagctggggctacaagcacatgccaccacacacagctaattgtgtgtgtgtgtgtgtgtgtgtgtgtgtgtgtgtgtgtgtgtgtttagtagagatggggtttcaccatgttggccaggctggtcacaaactcctgaccttaagtgatccacccacctcggcctctcaaaatgctggagttacaggtgtgagccaccgcgtccagcctaaagcaagtttaagagcaggagtgaaagtttattaaaaagttttacagcaggaatgaaagcaagtcaagtacactaggaagagggtcaagcaggcaacttgagaaatccaagttccccatctggcccttgacttgaggtttcatacattggcattcatctagggtttgcatttcttctcccttgattcttcccttggagcaggctgtccacatgcacaggggcctggtagtacttaggaggggctgcatggtcagtgtgtttactgaagttgtgcaggtgctcatttgaagcatttttcccttaccagtagagtgttccagagaaaggtcatataccagttaaactgcatcattttgtcttttactgtgcatgcctgaacccacttgctcaagtcctgagatcttatcaggaagctgctaatcaccagcttcaggtgttttctgtctattgggagactggtgttggctgtggccaattattgttttagcaagacagattaacaaccacttgatcatcacctgatggtcacctgacattccagatggggggccctctcctgtcctgctcgagtatgcctacctaggtactctagcatttctgccctcaagagtacaagactcaattatttggtataatggatgaaagtcagtcttttgtggtagtatgttctgtgagtcttggtctcttgctagctgtcagggaaaagtggctccatgggttggtgaaagtggtatccagctaggtccaagggagaagggcaggaattccactctgttgtgtttctctgatgggcattctagggtcttctaaaaggatgcctcttgaatattgagaggacagtatccctcattgaggattatttggaatttgatggcctgaaggcaagaggagacaaattgggttattgtgcttagaagacatgtacctgtaccaaaaagactaacaagtgggcctaaaaagggaaaatcccaggagaaccatttccaggtttcttcccaatttagccagttctgagtgtcttgttctcataaactggaagttcaatttaaaagttgtctgatgtggtcttgtacttttcccaattgatttaccccaaagcaacatttttcatctgagtctaaacagatttctccctgtgctgccagtaacatatctaggtcttgacaattttggaggactatggctgctaaagagtcaatttgttgttgcatagttgttaaagttttatccatgtcatcagtgttgctgggtatttcctttgagagttggctacaggccaaggaggcttttgtgattccagcaattccagtacccataccagctataatgccaagtcctatgagaaggggggttaattggatagacctcctcatcctgggaaggatggaatgcctctggattggtgctggaagagagagactcctggggatttgaagatgtcagggatacataggctatggtacaagttccagactagttagtcagaagacattggggaactgattggacacaaatatagaaggttccttggacttaaagacaaggagccttctatatttgtggagagggtagagatgtcaaaacacaataaagtctgaccctttctagcatagctagggggcatgcctaactctgtatgttcccatgccttgcctagaatttaatggatttaaagcaggcaagcagtacagttactaagagtcacagtagcagtttatactactaaagcatttagtagacctaataacctttacaattttacatttttttaaataaattccctttcacaatttgtttatgacttacataggtcacctacaacatacttggatgatttgacttgtcctaaacatccctctttgtaaacaactagtcattttactttaggacaagaatgtaccatgcaagatcacttctcatataaaatctattttctttataacctttcttaccaaaaaatctctttacctttataacctttgaattagactaaagtaattttccttctgttaagaagttatgttgctgtgcaagtactacgaagagggagaagataaggagattatctgaatactttagaagttattctccctcaagggattgctcagttagatttcttactagggcttctctgagtaaacatggactatttctaaacccttgaggtaggactatccaggttgaagttaaagatttaggtaactttcccaggagaaatagggctactagagggaaagattaattcagagtttgggtagatattaagcaggcacccatcccaaaggggtgtggggcttttagacattacctggtacttatgtaagaatagtaattggcccctaagtaatataaaggtgtgtgaatcttttcttttcgagggaagtgataccattttcccccattacccaacaggatttggaggagagttgcttagagaaggagattagcacagactaggcagctctcgaacccaaaagagaaatttataactacttcctgcctccagagttgcccttggctttgtcctgttgatggccagcaatgtctgatctgggagctagctggagctggaaccccttcagtttaaggcctttattggattggagcctggcccaggggcatttttggctcttggaacatcctttttccagtggctgagcttgtggcagagggggcaggctatgtgggggtttctcccatttggcccatttgggcaattctttttccagtggtctggtcttctgcaccaatggtagttatctagaggagtgtccttacagcaacctggagggggctggtgggcttgcagagcagccagtagttaagactccctcctgtttgtgcatttctccttctccttagccctgtcctccttattctgctctaggttttgaaagactgaggaggctaatttgagtatttcttgtataggggcactgggtcctgaggctgacttttgtaattttctaccagatcatttttaggctgaacagtattacaaaggaaaactagatttttgctttaagatttggggggatcaaaattttcccaggtttgggtatgcatcgaagggtcatgtcctgtggtgtgcagacgcaattaactatatgtgcagaaagaacaaaggagagaagaaaatgaagacatcctttctagttttcctaacatctttttcctgcacttatggcagactggagtgaacagagtgttccccattcatcctaggggttccagaatgaaccagtgcttactgggtacccataaccttggtcccatcttgttttatgaaggtacaattaaccatttgtgaagatacaacacatgagagaagagaagaggagggcaccctcccacccctgtttttccctgaatcctttgcctgtggcagatcagagtgaacagggtttcccccattcatccaaggggctctggaatgaactagtgcttgctgggtacccctaaccttggtcccatccaatttctgggaccagccttcatctctgtcctacaggtactttggtctcttatgcctgtggccttgggccagcctatatctttgttgccaagaccttacagtgactcttgttcagagcattctagaagttacaagagctggcagagccagaggtccaattagtgtgtgtcctggcaatgagccgagacacatctatgagaaagcccatttctttgttgccacacaatgcagcaaaagctgtggacatataaataacaaactgggaatgtggtcctgaaggagcacaagaccatttcagaatacagacagacaaaacaggagaataggcagtgcaggttttcaggaaacaagcagaggaaaccttgaacattacacggccttaggctttagccctaccactctcaggagcctcctgtccaagagggccattagtgcctcaggtctactctgtgcagactccaaggtccttcccaaccccatgagtcactcatcagggggagctgtgagatcagctgagaacaaagccactgtgaccaagaggaatcattctgggcattggttagtaagcaggagagtgaaaggggagaaagaatccatgtacaggggttgtacgccctcagccaaagaaagcaaggcatagaggtgtcttaccactagggaatgtgcctgagtcacagcaccaatgtatattaccagcagcaaatccatatggatctgcagcaaatcaatccttgcctccttggaggaaagaatttagccaaggggcagaagtaggttgaaggcagagggagagaccaagacaagttgtagcgggaccaaaagtttattaaaaagttttatagcaggaatgaaaggaagtcaagtacacttggaagagggccaagtaggtgacttgagagatcctagttccctgtctgtcccttgatttgaggtttcaaatactggcatggttctgggatttgtgtttcttctccatttattcttcccttggggtggcctgttcacatgctcagtggcctgctagcacttgggaggggtcacatttgcagtgcagttactgaagtagtgcaaatgctcatttgaggcatttttcccttatcaatcaactgttcctaaaggaagatcatttactggttaaactccaccgtttttcctcttggtgcacatatttgagcccggtcatccaaatcctgagagcttatcaggaagcggctgatgacagattcagctcttttctatctgctaggagaccgtcttttcctggtgtcagctgagaccaattattattttagagagacagtttaacaatcacctgaccatcacctgatggttgcctaacattcctggggcagccctctcctgctgtgctcatgtctccctaactatctactccaacaacctcactgggttgttttaaatattaatgtgttaatagacgtttgccccaaaagaagcctgctgaacaggaagatagtcagcaaatattagccattattttattaccgcacccaacaggcccagttatatcagttatatataaaatgcctgtctgattatgccttttttttttttttagacaaagtctcactctgtcactcaggctggagtgcagtagcctaatcatggctcattgaatcctcaacctcccaggctcaatcttccaactgcagcctcctgagtagctgggactacaagcataccaccacacctggctaattttcttattcttatgtaaaagtggggctcttgccatcttgcccaggctgctcacaaactcctagactcaagcgatcctcctgcctccatctcccaaagtgctggattgcaggcataagccatcatgctcagcctgactatgcccttttcaagcttaagaccattcaatgacttcctattatttttggaataaattccaaaattattgacatagctccacgtgagcattcttgattcacctctgcacacctctccagccatatctttgctattcactgtctccctcattatctgatcttgagcagcagtggcttaatttacatttcttaggcacacaaggttcatttggcctaataaagcccctgcatggcagctctcttataccttccttggactagaatcccagttatcttcccttcactcctgatgtttcttcagaaaccaacttgaagaatactttctcagggccatttactatgtgacattattatgtgaccactcaagacaagatcaaatcccatgtttatgcaatttcctaatacctagaattatagccaattagttacttatgtaattatatgtctttgtttctatcatgtaaattttattacattaagtttgtaatgaaatgggaaatgtctgtttgttaaccaaggtatcactagtgtctaaaagagtacctgacatctagttaacgtttaacaaatagttacagttatagaataaacccattataaataaatgaactaaaaaaataactgtggagttactctgattctgttctttgactttctagggattaatgctggatctacttagcaagaggacagccagggacaccttagagataattcatcctaaccactccttttacaaataaaaccagactccatgcagctataaaaagagcctttctcaaccttcctccagtcataagttcttttgtttctctatctaccataactgtgaaaggaattccatactttaactcgggcattagtggtgattagttgtccaattcataaagttgtgcattgctgaaaggggtaatccaaaggtctagaattcaaatgtcagaagtaatgagatcagtaaaatacaaggataaaaaaggcttgagaccacaaaaaagtatttcttctatctcatcttgtaaaaatcatctctgagtataaaatataacatgatgtatatttttaaagatttctcaaatgaactctaaacaggaaaagacaaaattaaggatagaaacttggatcttggttggtgctgtaaaacttgagaaagttatttatttttgttcttttccctatgagggaaaatggtatttccaatttcaagaaatccaaacatatataagctttgaaatcagaaaaattagaagccaattataccatttttaaagtattttctttgcttcctcaaatagtgagccacctaagttcaatagatcataatggcttttttttttttttttttttgagacagagtcctcgctctgtcgcccaggctggagtgcagtggcatgatcttggcttacggcaagcgcctcctcccgggttcacgccattctcctgcctcagcctcctgagtagctgggactacaggtgccctccaccacacagggctaattttcttttttttttctgtatttctaatagagaccgggtttcaccacgttagccaggatagtcttgatctcttgacctcttgattcgccctccttggcctcccaaagtgctgggattaaaggtgcaaggcaccgcgcccagcccataatacctttttaaacatgtatttaaattagatttttaccaagccatattaccaggctaagtaaaaaggtacctgtttcataattgagatcgtgtatatatttccaaaatgaccaaatacatacttttattgaaagcaacccatattttgaatacctttatcttatataattttgttctagtctacaccatcattgctactgacaaaaattatatagtactttattgtactcaagtttgttttgtcttgttttgagacagggcctcactctgttgaccaggctggaatgcaaaggtgtgatcttggctcactgcaacctctgcctccagggcttaagctatcctcttgcctcagccttccaagtagctgggactactggctaattttttgtatttttttgtatagacaggatttcaccacatcgcccagcctggtcttgaacccctaggctcaagcaatccacccgcctcagcctcccaaagggccaatattacaagcgtgagccactgcacctggccacatttcaagatattttgtattttctattcttgaacagtcttgactgaacatgaatgctctctttctgtccacccggagtagttgaaagatatttatttaaaagtgatattaatgatataaatagataaaagaagagtatcacctggataagaatttggaaataagagaaaagtttacatttgaaatgcaggttttacatgaaatatatatataatcggagttgttttttacagtgaagttcaactgttctttttgttcttgctgttccgatgctctctctcttgtttctttttgagtgtcacagacatttatattcctcttttctcaacctaacctttccctgattacaggcatttgtactaattactgtgattccacagttcaacacagacagctttgttcccactgctacagaagcacagagctgcatcaatattgagtagggggttcttgaaaataacctaagtggcattttggaatagatattcctccaatgggtaagatacctacctaaaaccacaaaatatacattcaatagcatatttttttgaaattctatagactttccaaacaacttggtttagaataaaagattcataatatgctaacacaaatgtaaatattgtaccaggtcacacctaaaggatggaaaagtctagtaagtgaaaatgcccattactcttgggctgtaagattttctaccagagaggttgcacagtaatataccctaactgttaagaatgagaaagtttgttgctgttgtattttgttttattttgtgggcatctgtaagaactagagaaaaactgtagagtcctgtgtgtgttttgtttcacctatggaatactgattctcttcgtgttaaaatgattaattcttatttgttataaaatagagaatattatataagttctggattcctgtattctcttgaaaatcatgaagttctgccaactctgggcccaatttcatctagcagctactgctgcagtatggtgcttagactcacagagggaggtggctttccagttcagccccaaccccacctctgtctttgcctaccatacactgaaacctagagtcagatggcatttatcattttttccctaatattagagttgaaaatatattttgtaaatatctgtgtttctatcaagatgggtaagattaaaaatggacccgaatagctgtatgattcaaataaaagaggtgtagtccaaaaagaaagaatatttctttgtggaaacaagggacattccacatatttaatttgtaatgttgtctgtgtgaaagactacatctttgtcatctgtgcattctactttactatacacatttatatttatttacttgccccttagtagcttagtctacagccactgtgactgtcatattcagccatggtgtaagctgacatttttttaaatgggtgtgtgaacatgtgtacacttcggaaaaagtggcaaaggatatactccctatgtcaactcattatacctagttcatgcgtttatcagttattttaactttcttttgtttatctttttcatgttatgagttttgaccatgtgcttgtgttagatttaaaaacagaaaaacaataaaataaaatgaaaaaagtaagaaaatggtttgttcagaatgctaaacacatattccctttttgttcccctctggatgcaattaatgcatacttcaatcttcatagaacctaatccaaaatgcaagggtctttataatcagccttcccaaattgatttttactcaatcaaaaccctcctctccagacatattgatttttttcattgtcccttaaacacacctgaactcggaaccatttcctccttcacgtctgtatttattctgttaagcctcttgacttccctcccagcccagaatatcttattttgttgatgcatcaaaatactcacatcattcaagtccagttcaaactccttattaatgcttcccttagacgccggaagtgatcgctgttctccctaattgcaattgcacttaaaccaactgtagcgaacagctcaatctttgttaaatatttcctcataattcctctgaggagcactaagaccctgagatattgatagtttttgtgatataaaaatttccatggcttaaaaaataatgcaaaaatgttcagaaacatttggtttaaacaaaattaaccagatttatttactgcagtatttctcagaccattagaacatgtgtagtctcctgctaatagtgaagagtggttttaatataaggaattttacaaaattttgtcagcatcaaactgacaattgtccttatgattttgtccatattttctagtagaataatgtcctgcagaagataatttgggtgatcccagttcataatatagttttatgtgtatctctttatttcaaaccagctagcaaatttctagtcactgaacttgttcttacaaatatttttacacgtcgagatccttcaacacttatgagttcatggtatgtgtgcaaaaaccacgaatagataaggaggggagtaacaatacattgtccattggctaagataccggagcagttcaaggggacagtcatcccagattcagggaaacaggaggaaacccatcaaaggatattaggtaacctctgacagtctggcaatgtttccctcttcatgacactcggtccttgcttctcctcttctgtctggaccaaatgatttcaaactcaggcttcctgtagctctccagtgtgaaagaggcttaaagagataggatcacttcaattcagggtgcagcctcatttttccctctgctgttcacatattgataggaactttacatctgtcatgtctccttttatagatgaatgtagggagggtggatgataatgcattccaatatttattcaatttcaaaatgaaagacaagttgaaaatccttcatgaggatgcaatccacggaaatatgagagctgtctacctaccatctctaacagattttggcctttgtttatttccgaagcacttatttgtcattaagataatttttgtttatgttttctcaggcatattatgattcccttaagtttccagagagccttgttctatgctctgtaaaggagaggcatatgtgggttaaataagaatttaatatatgcttaatgaatatatcacttatttgtagaatgcattcttgttcctccttgatattcttgccatgccaaaccatcacgatttctgtcatttgccaaagtatattcttactttgcacttacactgattacacctgatagcccattttgctgagtcatcctactgttctctgtgtccttacttctcatagtgttgtcaggaaaccagcagcataggcatcccctgagagtttgatagaatgcaaaattgcagctccaactccagacatagtgattcagaatacgcatttaaacaaaagtccttggcaattcttatgctcattagagttggagaagctctgttctaagtgttccctggatttttcactgtgggctgaggcacgtggtatatagacatctctctctctcttaacttcttctgttctcctgggcattgtcttcaatatttctctttctttttcctttcagcaagtgcacctgcttaggactcactaaaccattttcacaattaattttccatctaatcaaaaccctcctatccatatatctctactatcactccaaaaataaaagtttcattgaggtctgcctcccctatagttagctagctcagatggaagttgtaggctattccacttgccaggcatttttcagcccattgtttgcatttttgttccatcattttcctgaaactttttaagtcacaattacctaaaattgttgaacatattgagcattttttgaatttcagttgtctggtctctctgtcacctttgacactgttgttacgttcttccttaaaactctctttttcctcagcttctgagaaataatcctcttccgattccacagagactcagatggttctttctcatttccccacatctgtgttcccatccaatcggtattatccttccatccatgcatccatccatgcatccatccatccatctatccatccatccatccatccatccatccatccatccatccattcatcttcagctttctttttttaatctctctatacattttttataaatgatgcttctgactttcaagacttcaactaccagatccagagctactgattcctttcatcagtgaccatgccttttctcccacatgcctctctgaatgtgagatatctctccctgtcaatacaacccacactaaacttattttctccccacctcttccattctatattccttagctgggctggtagaattgaaaagtctttctcaactcctacttccttttctgtgcacatccaattatcccctgcattctgtcaattccactgtcttaacaactcttaagtctatcttgccttcctatcacatagttaccaacttaattcagaatttcttcattatttcttaccttcactgcaataatggtctcctagtaggttttctttctccttacccacagagttcttcctaatcaatttttcttacttcttacaccatgaaaaagcttcccttctcattctgtagccatctcaatgggtttgttcttgcaggtctaccaaaagcaaggaagggctcctgaggttataccaatgtaaaaggatagaaaggtgagtaattcagatgagatgtggtttctcagacaacactcccttccaacatctatgaaaatagatgaacatgaagcaaaattaaaataatagcaaatagtctgggcacaatggctcatgcctgtaatccccgaactttgggaggccaaggcaggagcattacttgattccaggagttcaagacaagcctgggcaaaatggcgagaccctgtctctacaaaattaaaaaattagccaggcatattgatatgtgtctgtggtcccagctacttgggaggctgaggtaggaggattgcttgagtccgggaggtcaaggctgcagtgagccctgattgagccactgtgcacctgcctgggccataaagcaaaaccctgtctcaaaaagtaacaagaagaagaagggtagcaaataaatagcaaaaatatagcaaaaaaagaaaatatagcagtccataaaaataaaagttcaaattgattctgaataaaaaacatgctttcaaatccatctgaagaattcctaccttagctactgatttgttatcagaaaaaacaaacactgtgaaatatttaaagaggtttattccaagctaatatgagtgaccatggcctggggaacagtctcaagagatcctgaggcctacaggtatcctgaggtggattcaaagattttctgggctgggcatggtggcttacatttgtaataccagcactttgagaagccaaggtgggcagatcacctgaggtcaggagttcgaggtcagccgggccaacatggtgaaaccctgtctctactaaaaaaaaaaaaaatacaaaaattagccgatcatggtggcacaatcccagctactctggaggctggggcaggataattgcttaaatccaggaggtggaggttacagtgagccaagattgtgccactgcactccagtctgggcgacagagtggcgccatctcaaaataataataataataataatttctgatttggaatttgttgtaagagttaagctttatctttagactggaagtctttgtctaaagacttgaagttagtaggcagaaatgctcaagttaagattgggggtgttgtgatgaccaaggtttctgttatgtagatgaagcctcaggagttgcagtccttacagagaatagatggtaaatgtgtcttttgggaacttgaaagttttcagactcttacttaatcttttctagatctgaaaaaggtctggaaagggaaggcctggccgcattaatggagattctctactgatgcaaatttcccccacaaaagacagctttgctgtcatttcaaaatatgtcaaagaaatatattttatggtaaaatattttatttccttcgggatgtgctttctgtcatttctgtcatgtgatgttatactagaatcaggttggaatttagcattttattgccacaaggattcttttttgtcagtcttaggatctctgttttaactttaatgcctgtcacttatgcctaagctccaaaagggaggggatataatgaggtgtgtccaacctcccttccagttacggctggaaattcaggttttcaggtctttctagggtccccttggccagaagtttgtcagttcagccagttggcggaactgaaaattttacttacggtttacagactttagaaataaaccccactaattgcccatcctattttgagatggttcattcatatatgaaaaactcctgttcctttacatcttgatttatacctaaaaactctgtgcaggtatgatttctgtcattccagaattctccatgcctacaagtagtgttagaaatttcctttttgcaaaactacttcttctgaaggagagtgttggaagctatcttatagtttggattcatgggctggggtttggaaaagagaattattccagggggttatgaagaatcctaaaatcttaacagagcaaaatctcccaatctatatatatgtatatgtatgtgtgtgtgtgtgtgtgtgtgtgtgtgtgtatatatatatatatatatatatatatatatagtttttttttttttttcttgagacagagtcccattctgtcacccaggctggagtgcagtggtgaaatctcggatttgccattgcattacagcctgggtgacaagagcaaaactccgtctaaaacaaaaagcaaaaaacaacaacaacaataacaaaaacaaattggccaggaacatttctgtttaggaaatttaagaccaaggaactgaactaacattgggtacttaccagagtctaagacctgttattcatgggcatttagataagttttctcatttaatgtttataacaactctattgataaggacatgttctcaatagagaaaaatgaggaaagataaatgaaaataacaatggagtacttaatgccaaaaactttatcaggcgtcgtgaggtatctattatataaagctcattttgcagatgaggaatgctgctctgagaagatgagtgagctgctcatggaaacgcagctcttaactgctaaagggaggaagtaaagctttgcctgctttacttcaaggcccgagctgttttcattataacaatctacagtctttaagataggtgaagaccattttggacgcaaatgagctaaactgcttatctatttgtgttttaatcaggtctgtctgtgaagttatcttccagctattttgtattcaccccacgatacctagcactgtgttctaccatacatgaccatcaataaatgtttgctaaattgatggatgggccttgctgtgctattaaggaacactcatcacgctacaggaattgctttgtccccacgttaacagacaactggttatgatgaacttctaaaggaaaataaaattatgcttctctgaaaacacatctaataaaatgaggatgttattatcatttggtttgtttttgagaatatcgatcttaaatacagttaaataaatagctggaagattggaaataacattaggaaaaagatcttttatgagacatgataaagaacaataattctttcatatatacatttaagtacaaattcacagaactccttctgaagaaacaattgattcactcctaagtttaagtacctattaaatatttcctagtaggaggtttcatctatatgttacatgtcagtagcattacgtcaaataagagtaactatttggacccattctttggggttgaggaatggaggtgatagttattatgcatgaagtggctgactggatggtgcacgtcgtagactgcctaatgttgatattcaaaacaatcatatgaaatatgtgttactataatcacatttagatgggaaaactgagtgaggaggaagtcaggtatgtttcctggcttacatgtctagtacatgataaagccagaatttaaatctgtatgtctgattccaaaatctttgtccactctgcttctcccatgctacctccaatagctcaaagtatgaagaaggtacagtgacgcaaatagggccttcatctaaaaagatcagagtaatagcataatggataataaaatatttacaatatcaacagggtcaggggtaagtgcatttgtagaaaaaaaaatgactggaaggaaacaccacaatgaaaacagtggtttcgttgtattatattacgttttgctattttagtaatggaaaattttaagctcatgaaaaagcaagataagtgtattttaggacaaggctttacatcagattaaagaagatttctgggagagaatcagcaagaggccatcgtgcagcctggacagagggagggaacgttccacactgctgctctaacagaacacaagcaatggcatatggcactaatttgtgaaattacactttaatttcaaacccaggttaggaagagtagtcatggctggagaacactgaagaaggcttccacctattagctcaaacagtcaggcaggtactaaactgatccagcaggcagcatgctagatgttggagatagagagttgaacaccgtcatgtacgtaaaaacagcatattgtaggagcatactttagggttgtacttctttatagatcctctgaagtggggcccttgagatatatatatatatatatatgagcaaatagaacataatagcttttctacttccttctgcattgctttttaaccttccttccttcctaatatgtgcatcctgcctcaattccctatctaccttcttgcatactggcccaatatagagaatatattaattattactttccttataatagcacctcacccatctgttttatccagaaacccagttttacattccattttcaaggtcagcgaaaaacagagaaggcctcagcattatgagtgctgccccatgagatagtaggtagaatggcccatctgttaaaacactgttcataattttaaatggaacattttaaagctcagtgaaatcatttctactctccagtacaatgaacttctattctcttacctcctggagaggttgaactgaacatggaaaatcgggcctttttggttcttgtagtgaatataaatggtgatatcaaatcaccaacttggcccaggagataatttcttgtgagtcgctgaggctggctgttcaatcttacatgttttacacataattccagaccattttgcagaaggtttcttggcttccatcttaaggatcaaaagcaagtttcctcatggtttgtgattctcatgccaaaagggtaaatgtgcaggaaggtcataagcagtagcaaagcttctctcacatctgccttgagcttgagcagtcaggcttgctaatttgacctcctattgtcatttagaatcttctgccaggagagtttttttcttttttaaagaagtgagaggcagataatttgtttaaattatttatatttaagaagtggaaggaacagggaagaaaaaagagatgtcttgattttctgaggagtatgccatggatagacacttagggcacaaaacagcagctacctggtttatgctgaaaaaaaaaacaaacatgtaaatagcaattattgtgcagcagtagccctgaggaggattctctgcatactcaatctttctaagcacccctaagtgtcttggactctccattacagaaaatgtgtttaggtctatgaatggaagagcgcacctgtgtgtgtcctgtcccagtgtttctgtgatgatgtggatgtcctatgaaaatattagtaacagatggcaatgtttctctagccttgatgttattctcatagtatttacaggtcgcatcaactggtcagatgtggctacaaagtaaagtcataatacttcaaaaattattcttcttgaaagctcatgtatatgtattctcaaaagacacactcaggcagttagaaccagtgtatttctatgtaatgacctgttctcccaaacatggttgtctcattgcccagggattaaaaggggaaatgcttctaacaatcagcaaaggcaaaaactgcaaagggatggaataaaaaaaaaaccataaagcagacataatgatttacagaggcaagcaatctgaggttatctatttgaggagccaataattacatgtatacaaataatctttggaggaatagtacaaaaatggatgtttcagaggttgacccaagtcataatatttaaaatccctagtgtaaggaggcacagagcaatataattttagaaaatcacccatccaaaatatattttaaaggattttcacctaaagatgacattccttttaccaatgatgtagactacattagttctccttccctttaggtctgaagttcagttagctcagtctcttttgtactaggtagagtttgtggctattcccttgaatagtccagatgactttgctcttaacaaggcagtcccagagtagttaacatgaaagccacgtgtgagggtgtgtgtgggagggagagaggagttggtgggaagaggaggtcatctgtgctaatggaaaataaactcaaagggcatatccagcatcacctttgtatgggaagagcatctatttggggttttcattttctgataggcagtgatagaattacaactaatataataaataaatagaactttagagagtgcaagaaaagaatcccagccctggccagtgatttgatttgctctagcacatccatctgactgagccatctggcagtgaaccagtggtatcagaacagcaatgggtgtaaccttgaggaagggttgccccttgacaaacagactggtgggaaaagtgcaggatgtggcaagactgaggatgaacaactatccaccctgcagaggatagcgacatagggagagaaatgcgtggtgcacatcactttgtcctgagtgtttggccaggccaggtatgaaaggcacttaggctggatacctaggaatgtctaacagcaggtggagcaggcaagaaaggaggccaggctctagttaagaagagattaattatggtttggagagagctgtccattcataactggcgggctacagagggcagaaatcattccccaatgggagaaattgttaagagattgagtgaactccaactatgaaggcctatcaacggacagaaggcagggcgtagagaatgttgtgatttagaagttatacagccaagtaccttctaggtacacctgtgctgtcagactattagaacaagagccaattcaaagttctattcaactttgagacttaggctgccagtattcccaccaggtcacatttggctaagacagctttacacagagaaatgaaggtcatcagcataaagacagagatgttcagagcttaaggaggaaaagtagacaatatcatatgaggacagaaagaggcacggggatgcataacactgtattaagatgaatattacaaagctgaaacaaagagtttttaaattctaatttgcatttccaaaagttatatgcacagatacttgcactgcttcatttcctctctacatgggggtctgggtggctatctggaagaaaagaaaaaagcttatcaattttttttttagtgccctattgaacacatcactgcattttaatctgggacagatggtggaaaatggcatctggttaatcaggggttcatagattatttggtgatacaacttaactgtgctgatgaagaaatgagaaattttgtctcttccctagagcagcattataaagcatccttcctggtgtttaaaattgattgtgcattctattggttaaagagtggcattttgaaaataaaattagggctgatttgcatttgtgttgaaacagttgcacaggcatttgataagaatagttcttttttcttttagaacacatttacagtttgcatttatttatattaactcaatgttttattcaacattgttttaaaagacaagacaaacatggatataattactcataaagaaaataactcttatgagtgagaatgattactatgtatttcatttgggaaaataaaacacaattttttttattaataaggacacaggcaatacttcagtaaatgtaccaaggtaattcaattttataacggacaattttaaaaggcattttgaaacattatatattattaatttttacatctagaattgtacttgtagatgccatcagaatactcgatcaatatctgtttattcagatttaagctccatgacttagttgcattacatttaatttatgtgtatttccttgattcacagtctgtagtaaattctgattgcttacacctgggcaaaatgtctttaaaattgtcaataacttccaggcagtaaaaaaaatgaattgcatgttgatggtaaaagaaaacaaactgctacatgtgatgcatgcagatttattaactaaataagtcttcattcctcctccaagtatgattgaaatttatagtcttgctagaaaactctattttccaagaaagtgtttgcaaagacatttgtacagtaattaaaatagttacttttccagtaattataatagggaacttggaaatatgcaaaataataatcttattttatttatggtatatcatattatctttgaaaagcaactcaggtgacatgatgtttaaaagttttaatctcctaaatgaaaaatatgttgctattgtagaattggtcttgtaagatggtgtcagagacaaaaatcataggaaagttcatagatttttttaatttttaagttatttcacgtaaatcatcaatggactctaggaagacataatccctcccacccctaccacacacacatacgaaaaactttacattttaaaaggccaggcaaatactactgagacagagaaatatatagtaagcacctggttgtaaatttaaccataaccatccagaaagatcagttataaaatggacattctgggctgagtatcaatggttacataaattgaactttgtcaggaaagggagggaactgagtttctaagtgggccagaggtgaaaagcaggttttgtgaaacacctagggatgctgcagttgaatagcctgcaattggaaggtagatctaagaagtaaaaatactaaaaaaaaaaaaaaaaaaaaaaaaaaaaaattaagatactactttgttataaaataccttgacgattctgtgctgatgatacatgaatcagcctcctcccatcagtacagtgaacttggtcaatgaactgactctaatgtgtgcttctttgccccaaacagtcatagggcagaaggtctaagctttagaagttgaatcctatgggagagggcatagcattcatgtaccatgacagacacatgttcattctctgccccataaggggcaaacaccattctgggtacttagggcatgaacgtgaaaaaaatagaccaaagttttgaggtgtggggtatatattacaagaagagaagagagagcacaaacatataaacaaataaataaacatgttccagatggcaataaattttataaaaataacaaaacagggtagggaggatagaaaatacaaggatgctattttagagaaggtgatcaggaaagatcttccaggcacagtgacatttgacagagatgtagaggaagtaaaccatgagctatgtggatgttctagggaagtgtactactggcaaaggaaacagcaggaacagctcggagagtttctgtttaaggaccagcaaggcaggcagcaagtgaggctgcagggctgtgggcagaaggaggatgatggaagatgatggctcagagctggtgataacaaagaggcgagatcaatcagaaccttttggccgctctaggaaacttggcttttcttttcactgaggcaagaggccactggacatttttgagtagagtgatgtgatctggtttctcttttaaatagcttattttagctactctgaggaaactgaaaagaaggaagacaacaacaagctgttgcaacaattcagaccaagggtgctaagagtttggaccacattgctaacaacagtagtgagaaatcagtgcctattctgatgtgagtcaatgggatttgctgatagactgggggtagtgtgtgataggagagagaagtgaagagaagtaatccatgacgccaagttttctgatccacataattaaaaggatggagctaccatttactgaaatggagttgataatgggaaaaaagtaaatctgaagtccatttgggggccataattattttgagatacttcttagctattcgtggacagatcaaaagatgtgacatgcttatcttgaaaaaaaaaaaaaaactaaagaatgaatgaactagaggaatatggtaagattaccagataggcctaaaaatcaccagagtttgtgaatttcctccagtggattaaaaactccaccagaaataagaacaattgagttagagcaagaaggtagggatgtttggtgaagtggttaaggtttggaaaaatacttagaaatattttatcttctaaacattataggggtagggatgttatggccaactgtgtggcttggaaaagttccttaattaattctcattgcttctactcagtacgcagttcttataaatcagagagaacatctctttcaggttgtatcaggagcattctcaaactaacactcataaatcggcaatttaggcagggaggaaaggaatattcaccgattacctgctatattccagacaccgtgcatgccgcttcacacatattatcttaattgatcttcccgacacattttcgatgtggaaactcttattttcattttagaggtgaataaaggttaaaggttaaagattcacctacttaacatagctgggcagggatagagcatggaatttgccttacctgccatcatttccatctgaagaagttgaaaagctgtctccaaatattttggtatgagatggggtacataaatacttgttaataacttgttcgactgcattatgtctagacaagaatatattaaattcggaaaagaaataattttaggagtgtaagctttatgaggatttagtccatgctgtcttatatacaggtgtattctattcattcactcacctaatattcatttggtgcttacaataggaaaggaggttttttgtttatttgtgtttgcctgtttgagatggagtctcgctctgtcacccaggctggagtgcagtggctcaacgtcagctcactgcaacatccacctccctgtttcaagcaattcttgtgcctcagcctcccgtgtaggggggactacaggtgcgcgccactatgcctgcctaatttttgtatttttggtagagacaggctttcgccaggtaggccaggctggtctcaaactcctgtcctcaagtgatccacccacctcagcctctcaaagtcctgggatcagaggcatgagccagcacgtggggctaggctaggagttatgtgctccatagttaaataagatacagttcttgttcttgagaatttcctattttatatatatagacagccagataatagcacactgtttctactttaaaggctgcactcctcttgcctgtttaatattcaactgcctataatccagggctttgcaaaaaatcattcactgcttttttgcagtgatcagttaatcaagcagagccacaaagggactcaagcaagggtagtagaaggctggcttctggaatacaggaaaagcctctgtttgccagagcccaaggttttaaatacagacaaagtcaaaggctgggaagaaagcaatgtgcgctcatagatagcatggacccaggagatcagccccagggatggagatcagatggaagccaacattgctggtctaaatagaggcagaccaagtttagaaattgaagcacagaagttcaactgtttcaaagagatttactgcagctttgaaaaacacgaactgaaaatcaggggtgagtgtggcagggcccacaagctctcaaagaaagagagggaagcgctaactgggcagcttctttggcttcttaggctttagacccttctgaagatgctgtatatctttctctatcaggacccagggaagttgggttgttccctgggaatacttactgctgcaccaggaggaagagacagctacagtgccctaagtccccagctccagtagcccttaaggatccctggtctacttcagctcctctttcgaagctgcctcactctgagtagttttttctccctctaagagaggcctattacccttgctgctgctgctggtggtggtgggggtgtcctagatttgtctagttgtttgagtttgggggctagatcttgtattggagttgaacttcaactttttttaaggggcaaggctcttgactgaaatttctttggtaaactcttgttcctagaaaaaatccagcatttggctccctttcattgaccttttcattctgtggatactaagcctcattgatctcccagctagattcacatgccttgggatattgcctggttctaggagggacagtaggtcatatcatgatagcagtggatgagcatggtgctgtgaggctggctgaagtggccctcgataaaggtcagaaacaataggcagaagggtacaccatttatacctactggtaaagtccattggtagcccatggctggacagaaaagcaatagcccctttcagaggatggaagttaaagtactagttataaaactaaagaaaatatttaggccactggaagtaatggttcattatgattattaaaacaacaatgacaacctgcaggctaaggatgtctttaagatattgtagaatgcctgagtagataaaatatgaggcaaaataaatggcagggaataaatggatctgataagtggatgacttactatccaagatgtagcataatttccacaaggctatattctaaaatatgcagttaatgccataagcacaaaagtataaaatgcactgggatctcaatatgccaaatgcactttagagtccagtgggcttgatcttgctgaggatggccatgcctcaacagattttagtctcctagaccttaggtcatttgtattatctgatagcataaaggtatgtggcatcatggaatgagctaagtaccacattggagaaatctccccggatacccaatgatccccaggacatttcattctgttcatatcccagtaccagcagaagacagagcaatctcagatgcagcctctgccaatctcgagattccttctgccagatctttatgtcatctcagaagaatagtattttttttttgtatccttgtcctagatccacttcacactgtgttaagcaaagtggctgagaaaatgcagagttatttcaggctgagacctatatcggataatcataagggctgtgtacaccataggatggaattcacttgctttatttttcaacatttaacacagtgaaagatttaaacataaattatttgattggctcactcacttacttgcaaggaagctcctgaatcactgtatgatccccatgctcccccaaccaattcctgaaacttggaaccgaagcattattttggaaacaccaatgcaacagaaatacatgctattaccctggggccagtacaccttattctgacccatgcttccctctctctaggattgctctccacggggaaatgtatcttgttctttggccattctcatgcagagacactgttccttccccatgtacctgttaggattcagaacaagaagtcacttaactctttttacgtcgaatagttaagagtacacaattattcaggaaattgtaactttgatgtatttaaatataagaagcatctgcttggaatctgacccacgtttgtagttcatgggtcaatcagaaaattaggcagggttttaaatgatgttttcactgctctgcaaggtgcaggctaaaacctttcctcttcactcataggtgggaattgaacaatgagaacacatggacacaggaaggggaacatcacattctggggactgttgtggggtggggggcggggggagggatagcattaggagatatacctaatgctaaatgacgagttaatgggtgcagcacaccagcatggcacatgtatatatatgtaactaacctgcacattgtgcacatgtaccctaaaacttaaagtataataataaaaaaataaaataaaataaaataaaaagaaagaactcacccagtgcagctcccttcttccaagtgttgactcttctccagaatttgcttgcttttgtctctcgccagtgccttcaggtggctgttttgtagtttttccagcatttatagttattttctttgggaagggcagtctgattgaagcttattcacacattttgaaggcatccctgaggaaacaggaagaaaaatttgcactgttaaccctttgccttgcgatcaaaaagtttgtaattattatatacatatcctttcttggctttgattcttttgtgatatgtgtgtcagaaaaaaaaaagaagaaataaaagaaaggcaagaagatgaatggaagaaagagataaaataaggcttttgattaatgtataatgacatatccacaattacagtatcaggcagaatagtttcctgttcctaaaagtttcccattctctgcctattcatcacttcctccctcctttcaaattcatgacaatcattcatccttctactgtctccatagttttgtcttttccagaatgtcacatatttggaattatgaagtatgtagccttttcagactgacttcttttacttagtaatatgcacttaggatttatcaatgcattttaatagcttcacagctcattttcttttagcactaaataatatttcgttgtatggatataccacactttattcatccattcatctcctgaagggcatcttggttgcttccaagttttggcaattataaatacagtgctgtaaacatctctgtgcaggtttttatgtggacatacgtttttaatttatttggataaacaccaagaagtgcaattgctggatcatacggtaagagtatatttagttttgtaagaactgtcaaaccaaatggtacagtggctgtaccattttgtgttcccaccagcaatgaatgagagtttcagttgctccacattcgtgtcagaatttagtgttatcattattttcaattttagcattctaccagatatgtagttgtatctcattgttgttttaattctcaattccctaatgacatatactattgagaatacccacaattttacaacatggtatactaccactgctgccattacttgcaaacacctagttaaaactttctatgtactaggcactatgcagagtacttttcatatattttctcataaccctacgagtcagatacaccattattatgcattttcaggaaaaaaatcctgaagttgagaagagttaagtacactgctagtaaatgttgaatctatgacgctggggtctttctgactccaaatctcatcttttaaccactacatacatttttcctcaaagtgtgatcccgaatcccatacttcaaaccaagcaggatggtgataaaaattcagaattctgaattgtaaaatattgcattagaatcttcatgctgggtgtggatctggagtgggagaaactgaaacacactcaagattaagagccattatactaccattctaggattactcgaagtccaagtagcagttttgatactttgtttctatcttgtatcatgtatttctctttgaagtatatttacaaaatccctgttatttatataaaataaattatactaaaaacattgagattatatcttaaatgtaggtgaatatatagttttctatgttccctaattaaggatgctataaaatcttttcctcatacactctaccttagagataaatttgacaacaggggaaaaaaaaaaaacaacctcgagtctttcaaatatctactatgtatcattctggtatagtctgattgtatcctcccaaaattcatattgattcagttgattcaattgaaatcataatcaccaagttgatgatattaggaggtggggtctttgagaggtgattaggtcataaaggcaaagccctgagtggaattactgttcttataaaaacactttagacaggtagcttgctccttcccacatatgaggacacagcaggtgccacctataaactagaaagtggaccctcgccagactccaaatgtgccagagacttgatcttagacttcacagcctgtagaactgtgagaaatcattttctgttttttataagccacccagtttatgacatttttgttataacagtgcatagggactaagatatactttgtgctaggtaaattgaacaaagatcataccaaatacttctagcattatgacagatttatctaactataaaagtctatttaatgtcgttttattggatggaaaaactgaatatatttgcatattttactatactatatatactatatatatgcatatatagtgtgtgtatatatatagtattgtatatatgctataccatagtataccataatatactacatatatagtatatttcacgataatttcaggctaaggaaaaagtcattattgcaggcactctatgaaaacttattaattaaaataaacagacatgtttttgttgtggcttttgatccaagacaagacattattaaggatattaacaatagaattgcctgtgttcaaatctctgctatgcttctaagtcattgtggaactttgggcaagctttagtaacaccttttaggtcttggtgtacaagattctaaatggagataaggaaagcctctacactctagaattattgaattaaaggagttagacagtgcctgattcacattatactttcaataaatgtgagctattattattttcattattattattctcaaaaacaaaaggaaattgagtaacagagtggtagagtggaaagcgtggcagaatggtagtgtgagacccaaaaatataagaatataaatgatatgtgacaaatccatagtgtagaaattgaatactctgagaatgaaaaactgaagaaatcacttttcatgggagtgggcagggatgcatggcttctttgaggaatctaaataaacttgaaaatgtttttaggtgaaaagaatgtgtatttggagtggatgtcctcagggatgtacaaatttagagactttagctctttttggtagatagggaaaccccgtttggaccctcagacacagcccactgtgtcaagacttggcaatttgaggagagatggtgtcaaggtaggtgctgtataagaaaggaatcttagacacatgaagagaagccatcctttcttgaaccccatttgcagctacaaaattgcagactgagtactacagtcttttaaacaagcctgtcactgagttcacaaaggcaagaggcattgtcacctgaagccacaaatcctgctaagagcattaattgttctctatataacataggctgtttagttctgcaatcaataagaaagagtgggctcagatcaggacctattgcttttcttcaggtaaacttggaattcaacaaatagaccacaatctacaattttctccataaggcagaatgcaggctaagttgatacatatttacaagcatggaaatgagttaatgaccttgagatgaggatctcagtgacataaacccccattctctttacaacttcttgagtttgtcttggtgtttgctaactctgaggaggtctaaaagaataaacagtgtctgcattctgctttcaatgccataaacacattttggagaggcaggagcaattttatagctgtacatacactggagagagagcatgaccctggagagctagaggtttatcatcactttaaaaaataatggttgagaaggaattgctctaagtgtagtctctgtcttttattttatattttttaatagctacctcttattgagtgtttactaagagacaagaactctattaggcactgtttaaacttttattttaaaatgaaacacagatacagcaaaccacacaaaattattataaggcaaataccatcttaaccgctacgcatgtcaaagaatgaaatcttgctagccatccagaagtctctatacattctctgtcctctctgtctccaaaaataaccaccctcttgactttcatattaatctttttttgcatttttattgtttaccatttaagtgaacatcctaaggcattataatgtcatcaattttcaaattgatatgtcttttagcttcaatatcatcaatgtgtcatctcccttgttcccacaaactcctttcccttaaaattaatctgttgacaaatatgggccacttgtggattttaccccagggtggatttgatgagtatattgatatactcatggtgccaatttacatgttcttctcttctctgcatttccagcaagtggcagcaggaaccttgatcaaactcagcttttatattgtttgcaacactataggtagcactgaatctttcatcaggaggcaaattgatgctcaacggcagttggttattttcttggtgattataaaatggtgatactctaattctatccattatttttacacattagctcaaataatttcatatgtaaggtaattcttcctttcacctacaatttggttacccaggggcataactccaaaaaggacagaactgaagtttttatgataggttttgtgataataaattggttccctatcatcctcatcaattaggatttaaatttatctgatggatcccaatgcactgtaatttttatccttattgaagtgctattttttccttcttcatccaggtggaggcttttcaaggttaacttttgattcctcttgaactagtagtctttgatacttcccatgttagttcataacaaaatgtttcagatttatctggtgtgctccttttcttatatctgtattcagcacttttctaagaaattctgttttgtttgtctgtttgtttgtttgtttgttttaacaccacaacctggttgcaagtgatagtcattgctactagggttgccaaagttagcacataaaaatacaagccacgtagtcacctacttgggacatacttatactaaaaaattattcgttgtgtatctgaaactcaaatttaattgagcaccctgcattttatttgacaattaatttatactaggtcagtcattatttttagaccgagttaatctaggtcctctgagaagcaggtgcaagtggatgtgcaagagagttattggagaaaatgcctgtgagggaataaaagagtgaatggaaaaagcaggaataaccctttgactgtgatgtaggctttactgctgtgaaggtcaatgggaagaaaggagaatagatagaaagagtctcaaactgtagttcaggtctaagaaatatttaggagggttctcaaaccaaagctgtccaacggaggattcccacaagccctatgaaggggactgcttcagtatctctgccgcctgcactcagtcattcgcctagcacaagctgtgggaagcatagcctcactgctaatgctgttgtgcattaggaatgagataataatgatatctccaaatgaaaatgtccaattcaatttcagggctattttctaaaggaacatcttctatttgcctcttatctatagtgaaaattatagttcttaaagccttggcgattagagagttagaacatctcataattactcatttacttttccaatattatacacacaacagaaaaaaaagtaactatacaaatattaccaccacccattataattattgaaaatatgttttcttgcatatgctatctcattctctccatttggttgtactaaatctacattggtagataatatagctgttatgtactctttcctacttaacactcaatttgtcttattctactatcactaaatgtgtaatccaccataattcttaggcttatgtctctccagttctggaatgttcgcagtggctcttagtgacatgaggtattggacaattgaaacatgtctggtctaaattggtatgttcgtaagcataaaatacatactggatattggaaatttactatacgatgtaaagtctcatagacaattttcatatatattagatatcaaaatgataaaacgtttagtgtgttgggataaataaaatataccattgatttaaattcttctgtttctttttactttcttcaggtggctactaaaaaatttaaaattacacacttttttttatttaatggcgatgttcctgttaattttgttttctaaaactgatttctagaagactcctcaaaaaactcccacgaggacaatattccttgggtgattgcatgttggtaacagtctttctatgaccgttataattgaaattcagttttactgaatataaaacctccggtccatattgtcttttcttgaatgtcttaaatatgttacttcatttttttctctctaagataaagtgttactgttggaaagtttaataataataatcttagttcctttttaactcaagtattcttttgccctacatgcccaagtaattctttttttcctctttcttaattttacttcgtgttgattgtactacgttaatattatcagttacactatgagatttttcagtaagtttaattgatttttttaaatttcaggattactttcttatactttttttttttttttgagacagagtcttgcactgtcacccgggagtgcaatggtgtgatctcggctcactgcaacctctgccgcctgggttcaagtgatcctcctgcctcagcctcctgagtagctgggattacaggcacctaccaccacacctggctaattttctgtatttttagtagagctggggtttcactatgttggctaggctggttttgaacttctgacctcgtgatccacccgcctcggcttcccaaagtactgggattacaggcgtgagccaccgcgcccagtcagtattgaattttttttttttttttttaaatccttgctttattctctcactcagaaactcctataacattcatggatctttttgccatctataatacatgtcacattttcttgaaacctctttctttattttttaatttctttttagtgttaaatatttttctccttctcaacttgatttcctttaaagtgttatttttgtacttatatcctcttattttccttctagattagtcttattcctactatgctgtttcttttctttctaattttttcttgagtttgatctctttttctacttctgattaatgtttttttcatgtgttgcatgatgattttcttaatgtcctttagcttattttaaaataatatgttacacttttgaaaacattttgagcatgacattttttggcaggcttattttgtcaatagcagaagttggtaaatttcctgtaaggttcaagacagtaaatattttacactgtgtaggccatatggcctgtcacaaatacttaacattgccattgtaccatgaagatagtcataagcaatatgtaaatgaatgagagtagctatgtaccaataaaactttatttctaaaaacagaaagtagactggatttggcctctgggctacaatttgccagtctctggtccataggaatttcattctatgtttccttgtagcaactttgttttgggggctaaactttacatacatggcatttgaccttgatagttttctgttgctcatttttgtataaatttagtttttttgaacttttagataggtaaaatttaagactgacttttcaacctaaaggagatccttcttctcttgttatgtaacagtaaaaaatagatatattggcttgttttcatagatttcttatatctgtttacctggaaacaggtttgtctggattttctctttcctgcatttttattatgtctattcagttcaattttgactccacttctagtagtttatcctcagtatggggtcctgttttggaaagatgcctggaagtttggtttcaagagttcacaggatctagactgcaccagccacctaagaccttgacatagacctgctaagaacaacgaaacagctgagattttatactgctttcgagctaatgagttaacccgccaggtttatggatgtcggcaaaagacatgagactgagggtcagagacaaagactttgattactcatagtataatgagtaggatgaacatgaacgtatttgtgtgagttcttcttctcctcaagtaccatgggaggggtggttaagccagatggatgcctacccacacagtagattgcagtttatagaagaggaaccctgagcttaaggaacccaaatcttttataatggggagtaagcatgcttgttttttgttccagaggaagacattatcttttttatactgaagagtaataatgcttgtcctttgctccagaggaagatactagtccttctttccaggttaattgctgcacaaatattctttaaaagatattatgaaacagggtattttcttctgataagaaatgcagaaatatgagggaccaatttcctgttgggaaaggggctccccacagggcccattttacttactgttggaatgcacaaaacctctcctagttccactcagtgttcttatgttggtccactgtagtttctagtgaatatgcattgactatttgggggttcctttcttaaatattttggaattatcacaactgtaatttgccctactgctttcttctgcattcgctcacatagacacaagggcacccacactgtgtggcttttggtgtttacggatttgcataggtatctagttatttagaagtggtgtaaatgttgtacatttggttctgatatctaactctctatctagcctaaacccatgctgtcatcacagcagcctatcttcccaaaataaccctttcaaaaaaagtatgccaagcctgattttaccttttttgaagtcctcattttgagcataaactttatttttccctaaaatacttatatttttccctaaaatacttatttctaagatcttcctaagttgcataaaaatacttgtctctcctacccctcccccatactaagtggtactaagttgttattattttaagtggaggggccagtgttttctttctttgctttctataacattctgtatcttattttcttgctatatttgtataccccatctatcagcaattccccttaccctctttccaaatatgttgtcaaaaactagcaaagcagataaacaagcttatttaatatgtgtgcagaggatgtaaagcaaaaataactatcttctgagattgagcataatcttagaaatttctattgactttatggtccttttggcagtatatatagtctagaggaatttaagctgtatttacaacaacaaatattttattcaatttcaatatttcctcagcattttgcccattatagctcttcctcctccaaatttagtatagtgtttatatattaggtaagaaataaattaggagtgatagtgcaaacataattctctccaaattctcctgtgagctctccacactggaagcttggtacttcataacacgtagtacctgctcctaagcagtagaaaattccatgcttatgtggcttttacttaatgttttagaactaagcaatatctgatgggttcttactcatatccaacatcagtagatcagatgctgatatgatgaatcttgataagatgaatcttgatattcagaggaatatcaagactatgtaattcctacatgtcaagtagagaaaagtaaaatattctgggacaacagaaagagaaaatatattttccctggatgatcctattcagtaaaataaaaaatacaagattataggagatgctaatagagcttaatattgagagggtgaataaagatttttttttcaaagagcatttcctctgaggctccccctacttaggcaaggagactgatgtagacccctacccaccaccccctgagcacacacacacagttaactccagtccccaacagaattcctctccactaagcattgatattagtagaaaagataagatgccccatatgacaattaggatgctgaacaagctattaggttggtgtaaaaaaattgcggttttgccattactttttttttttttttttgagacagaatctcactctgtcacccaggctggagtgcagtggcgccatcttggctcactgcaacctccgcctcccgggttcaagtgattctcctgcctcagcttccctagcagctgggattacagtcacgtaccaccacaccaagctaattttatttattttttttttttggtattcttagtggagacggggtttcgccatttgaccggcttggtctcgaactcctgacctcaaatgatccacttgccttgacctcccaaagtgctagggctattatatttaattgcaaaaaccacagttacatttgcaccaacctaatattagaaactaaaggcattcaattgtgcagtgagatagacactacaaagagtgaaagaagaaagtccctgtgaacttgcgatgggaaggttgtgaaaggtgttgagtcctaatagatcagttatattcgggaagatgaaaatgtgagtggatggcttctccatgtgaaaggtcaggggacccctgaagggaagaggactgcccatttgtcctgtgaggcttttgatgtcctattaactaagattaaacactcttataagtgttgctcagtaaatcaagttgctaactgaagggtgattttctagtcattgatatgtaagaactatcatatctgtaatagattcctcctcctcctctgatgcttacggtctaattgttaagtgtaacaaatgataaaatattacaaggcaaggtaagcttgaaattaattagtaatatcaagtataacttactgacagaggaatgaggaagttacacttttgactgcattctaaaattatacaaatatatagaaaaccaatggcagaagcaatatttaggcataaccagtgggatttatggtatttcatttcatgattcttatgaaggtgttaataagccaataagacttactacaccctaacatccctaacaacttcagaatgtattctcttggcgtttcccttccctttttctcctcctactctaccttgtctcttcctcttctttctctttcttctttgatttggataaagatctgtgactttagtaaatatttagatatgcaggatagaaactgagtgacttaaacatttccttactctcccaaaaagatacagatgtgtgacagattgacagacagatgaatataacaagggatatacactagcaagcaactcatcgtgtctaatagatgaaacagaattaaacaatgttcagtattgaaagatgtgttttaatgtgtcttatttcaatgtactttgcctcccctgatatcccgaaactattatttgtataatcacctgactctgcatggtgaaaggaacccaaggacttggcctcaagtttcctttggcaatagtggaagaaaaatccccagtggtagaaagtcaattggtagagacaatgccagggactctttaatgtcagcggatgctctagggctattgcaccagaatcttcgactatctcttgttttctaggggaaaattcatgggagaatttgaatctagtactaaatctttaaaaacaaattgaacattgtggaagtgttaaaaaagatgaaaatctttccttccaaaaattagtcaagatcttacagtagaattttctctttcgatttgtaaaagattttctagaatgggaaatgtgttttgtgctattatgggaattttataaggaaagaaattgagtaaccactatgaagtctaaatctaagagaaggctcagtaatatcgtacttttcaaggaataaaggaagattattttgaatcattagggaatcttgtcttggttatggaaacgagaaataccagattcaaagaaatttattcatcacaggcagacattatctcaaaaggacaaatgcgatgccaatgtttctaaatactcctccatacatagcaacctctgtcatttgtagacaaatctgattgagaaaactttattttatttctaaagagttgtgaaaatcaggaaaaaaaataccattaatatcagctcaaagagatgatggaaggttttcttttttcttttttactgtgccgacataaccaattcattaaatgacaactcttaaaaaataaagagcaaaataaagaaacacacatcccttgttgggcatctagtgggtaaacatgacaacagcaggtaaatttctcacgttctcaagttgttttggtgttacaattcagctacatgtatacagagaaaagcatacacggtaaaataatctgcattgttttactgtcttaattcctgtatatatgacacagaagggcggtggggtgaaaggaagatgtgaggttttaaatatagcaaaaaaaaaaaaaaaaagagagatttgacaacactggacctcagtaggcatgggcaatttgttcaatatcttcaggtctccagagagcaagaatgactctcaggatattgcaactctgtctgcttccaccagagatcataattgggctatgaatttttataacaggaaagtcttcctgtcaaagacagagactgacaaaaactttagttaactgatactgaaagaaactcaaaacagaatgaatagtatacatgagtatcacttatatatatagtgcctttacttctttcttcttttttactttaaaagtaaattcctgttatagtttactggttagagcttctaaaatgtagcttgtttatgaggattgctcagcatactggttttctgtccagggacatgatgtgcattttggggaattcaaaacccgattgaggtgagtagaggtcattcataaatcgaaaccaaatgatagcagaagatatgaactaaagctatttctttatctgcaaagagctaattgggcatatttcaggccaagtctctgaagacacagctcgtgaactctgtcttcttgatgctgtgctcattatagacactcaacagaggactggctaatgctagggaaatccccatcaaggtggtctttacatgacactgcagatttacctcaggaaggggagcaaagagaaggaaaatgcagtgagggtttctagcaactagctgcttgtggagtactgtttgccttgtctaatttatctgaaactgaagagtttgtctctaaagggtatcctacttcagaaaatctcaagggacatttgtctttctgacatatcagctgttagctagaccttatttcttacttggttgtttttagagtaaattttggttctttggtcctttgtctgctatttgaggtggaggattaaatactgcatagatgacctatgtatgtatagaacaacctaattttgccacagataccaaaacactataacgataatcttcaattaatccaattattatctaaatttcataacccgtcctcaattatctaccttaatatttctaggtaaagagagatgtactgcattgacttcctgtttttaaagggtaaaacagcaagagaaagaaagacattgtagatattcacaatgttgtatgtgaggaagtttttgaatggcttcagaaacccaaatgaatatattgagaaagcagcattgtgagttctgtctacatgtgaacccaaaactaggatttgaggtaatccattttcagaaagaagtgatggagtttgaattctaggaaatcttcctgaataaaatggccatgtgttgtaaagtttagatatttataacccaaaatagaaggaattttgctaggtgatctctccagttccttttcagttatgagagtctgatttcttcccatgaaaagtgtagaaaaacttcctttactgttatatgaatgttataaaatgtatgcttgtccatgaattagctgatcaaagataatacatgaaaaagtattcaaaatactctgtgaatcttttttttaaaaaactctctttaaatagatttttgtattcagaagttatgctttgtaaatacattttaaatttcagatttaaacattatcaagacaaaattgtgactatgtgcatgtaaaactagagagcactggaaaatatggtggatggtaagggccttttgcaaggtaattaacttatctattgagttttttttttttaatttctaagtacttaattgactctcccactaaaatttaaacatatacaaataatttttcattcagaagataggcatttgatttataacatcaacatatcatcacaaaaacttagagaatgagaatatcttaatgggcacctggtctaaacattttaattttaccaggtaaaaaggtggaagtggcatggcatggtggctcatgtctgtaatcccagcactctgggaggccggggtgggcggataactaggtcaggagatcgagacaatgccggctaacacggtgaaaccccgtctccactaaaaatgcaaaaaattagcttggtgtggtggcgcgcgcctgtagtcccagctacttgggaggctgaggcaggagaatgtttctttaaaaataacatcattagaaaccatacaaaacagaactgcaaatactcccttctaaggtgtaaggtattccaacatttcttgtttggacgttagaattttttcttcagtaagaaattaagttgaaaatgaagtagaacatcttacactgtaattcaagtgcaatacattaaaaaaataaaaacagtgtttaaattgggaaaatccgtttacatgtgattaagttttaatcagtgcccttaacccagatctcaacagctaaaaatgttcttagcttgacaaaataacaacccatccccaaggacaaatacttaaatcaaagaagcattttataaataaaaaaattcacgcacacatacacacacagacccccacaatacatgaaacatataataatgtttgtctttatttgtaatgaagtggattttatactgaattcagaacacagatgcaaattcaacagttgaactcaatcaaataagtaatcttatataaaaggatatctccctccagcatgtacttatcctgtgtgacagatatctctgtaataaagtaaattccttcaactcaagcagattgtccgaaatggaaacacaatgaaaggatgaatatactcaaataatcaacagaagagcaaaatataaaaatgcgaacattttctgaataatgcagatgccctccctccaaaagaattacatgtgagggaatatctatattgtcataattactggataagctgcccaatagctattacactaatgtttcattaaaaatatatatttgctttatgcttttgcaacttgcaaagttattcctagcaaaaagttatttctcctgaaacagaataaataggtctttcacaatatgcactggaatacatatttttgaaaaacaagatctccactcacctctaattctatctttctgctggtgattactgatatatttattttaaaatacatactttataggaagtatcgttacaattaatatttaggacaacattataattcgtgttttagaaactactaaggcaagaggacagctcctaccattctacaaaagtctttcagttaagaagtgactaattaatggactgagtggctcagagcagggagccagtccttagccaataaagcccaactcactgccaccccactgccccatattctctgtcctctctgctggaactgtcttgtgctgaatacatgaacacctaaatattcaactcactcctgccatttctccggtaagcaatcttccacaacctgtgcctgagacttggaggctgtttgtggtccacaggctttaggcgccctagggaaagccacgtgcactagtgcatctggatgaactgtggactttgtctatccgcggtaattcaacttcctaagagctacattgactcattgatttgtatccaggctccgggctcccaattcccacacaacgtaagctccctgcagccaggggatttggtaggtttgccgtgttgtttagtttctctcccctgcgaccctctctctgagcctcacagtgtgtttggcacgtggtaggtgctcggtaaacctactttgaatgggagagggttgtgttgaagaaaggaaaggctgggaggacttaagatttgaaggttttcctacacgtgtccaggaagaaagaaaaagaaaaaagaaatgagtatcagagtcttatcatcattacagttcttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccagcttattgctagcgtgggatagagggagcgcacgcggctaggctccagcagcgactcggcttttcgcgtattctaagcactgaagagcctcttaaggggagctgtccaaatcgcccaggagtggtggcgagacacaggaggccatgccagcgatgctgttattaatattgcagacttggtcatctctcctggcttgcggtttcttttctcctcttccctccccttctcttttctctcacatgtgtttcacacaggtggtggggattactcaatgacttacagctcccttctcgtttattagtgggagggggttgaatgttggcagttcttacaaagcatttgttttcttaaacgatcctgtttgatccatactctgagataagtatgaaaatattaaaacatcatacgttccttccttttataccccttcctcctaatccccagcacacatcagaatgtaaacattggttagcagatatagaaaaataatttcagaacgggaacatggattgaacatcctctttcaggctgacagcccttaaatttcattaacaagccgccgagcctctctactgctctgggaatgatgctaccagtaagaaagattagccaggtgagagtccccacatgaaatctttgctcactaacctgtgacaccagctggttacttgaggcgctgcaaacagttcagtgatggtggaagtgggatgcagaagcagagcagagcagagcacacaggagctgaaaatgtatgtgtagatagtggacacgctgtctatacacaacaaatccccttgtcaggattaatctggtacttaaaattcatatgaagagataggtgcaagctcgaatccatttttcttgttagtgtgcattttttaatagccacttcaaatattcagggagtggctactttgcagaactcttgttttaatagagtattttaagtgcctttctgagtattgacatgatttgaaaatgtcagttttatgaatcttatgcatgtgttctaatagattgattttacaaagaaagtcaactgaaatatacacatggcacctcgcagtgagggtgtttcaagcactcccaggaaatactcatatctagcatatttttgttcaaagcttgacatatgaaacgatggaaaaagaatgtgaatgatttttgtgacagcttaaactactttccgtaagactactaagcttttattagccatattagtcattatggtttaattctgcaattgccacacaactctcgtgcaatactagatataatatagcttcataaagatgtgattagttgtgtgttttctataatatttcataaaaaagattcataaatttaaattaaaatgtacctttatgaaattttacctagtggttaaatagggcacatgttccaacaaatcaatcactatgcattgattttgaatgatttaagctattgcatgtttccaagaatgtcttctagtttctatggtgaagatttttatgaaacctcaaagatgccttgtcctgaggccatcaaacacctatttccacttatagcacagtggaagaccataatccttcctgtaactgaaaatggttatgaaccatataatttggttacagttacagtcctgtagagggctcaaccttcctcttttatttgatctgttagtgtcctctggcacagggtgccatgacaagaggacatgccctccctccctagagaatggtgacaacaagaataggagggaccgtgtagggaccgtgtattttatgaatattctgaatcattggaaatatttttatcatcttagtaatctttcttttaaagattctttgattacaaaatatttatgacagttatttttgttgctttcacaacactccacatttacaaaatatctaaaaacaaatgccttgacatgactagacacaatcatttcttaacatgatcaatatctcaattaacattgaaagagctaagaactctagtggctaattgtaatttattattatttttaaaaatcacttcctgaatgcttgccacaggcagagtactattcttagggttcataaagtaacatttcttgaatgtatttttctatttgattctcaaagcagttttttgaggtgagtcctgtttttattcctattttagagatgagaatacagaggattaaggaagttattgtggaagtgagacttagccaggaactcatggaggtctgaagcctcaacttttaacttctatacaatcatgatacaacatatttctattgtaagaatgaaaataattgcaaattatatgtgtatgtgtgcacatgtgcacaaatttaccttgaatataaaacaaatgaataatttgtttaaagcttcaactatacaagtaaatcacagctctgctaattttagttaatatcacgctactgatctaaataatataaaagaacaagatagatcctcataaatttataggagctttttttgatctttgtatcatttgtctctgatgacgagactctcaacgtttgttaaatgagtatatatatatttttaatggtcaatcagacaaggtttagagtttgttcacatttccaccaggtggcacccttctgctgactccagtgggtaaaaatattgcctaaaaagcgtggctgttctctcagctccaaaagcaaaacaaaaataaccacacaaaaacaaaaacaacaaaaacaaaaccatcccactttttagagtatgactaaaaagcatatttttaaaagcaactatttgactacaaagacagcacttgttatgcattttctttaaaaaaatgcattttggtaaaaaaccaatctcttacaattgaacgtgaagctgtcacttgatgaaataattcatgaccagaattgagatcaaatgtgtaatgtgtaaaatgccttctctgaaatatcgatgtgctttagacatttaggtaatatcaacttaaaatgttttaatacagaaattggtattcagtatttttattttacctttggtctagcaaaccagattaaatattcaaacatatgcttaatgaaaaattgcaaaagagttattcttccatgtgccctttgctaatatatacacatcataatttgatcaataaactattgtttttaaaacacaaccatgaaaagagctttcataaatcatattgaaaaattttaattaataaaaaacatattacttcgaattattcaacatataaaatgtcatatttaattgggagtagagttctatataatttggttataaaagataatatacattaaataaagatgttatatggaagtctatgatttgagagaaaatatgcatttcctactctccctgaatttcttatttttatatgtaaatattatatattatataaatttataatataaatatatatataaatttataatataaatatatattatataaatttataatataaatattatatataaggcattttgtttattaagaacatacaacaaatatctcttgcttagaatcttctaatatatctatatatctgtttgattatttcaggatctgagcaaatggtacattttaaaaagattaaattatataaaacaacttaaagaaaattgtattattaaatatcaatgctgcattatcttatgaagcacattacattggaaacaaaacaaccaaatttctcccagtctcagtaaaaataaagcaaattcaaaattttggtttcttgaattatttatgattacagaatgtcttaagctttactacttataggcacattttaaatttacttacagtgtgacatgtagcagacacaatgccagaatgctgtgactaagattgtgagattttgtgctatcaacaacaaatatttattcatcactgtctatgggttatgcactggaagtcacagagtcaagttcatatcccaggtccgccaaagaccagtgtgttttcttgggcaggataactgaatttccccatttcacctgtgaatggaggtgactgcagttccctttagatgtttgttctaacggttaaatgaaataatatgtaggagtttttgaataaggtctgactcataccaagtcttcttattaaatgtgtagtctgggaataagagcctagacaaaatagaaaaaaaaaaaaaaatctgggcctggtgcagtggctcccacttgtaatcccaacactttgggaggctgagatagatggattgagcctaggagttctagaccagcgtgggcaacgtaatgtgactttgtctctaaaacaaacaaacaaacaaacaaaaaacaaaaaagaaaataaaaagaaaagaaagaaagaaagaattatcagggtttagtgacatactcctgtggtcccagctactcaggaggctgcggtgggaggattgcttgaacctgggaggtcaagaccacagtgagctgagattgtgccactgcactctagcttgggcaacagaacgagaccgtctcaaaaaaaaaaaaaaaaaaaagcctcagattattaagccgtgtatagctgatccattattttaagtttacagacaaccatattttgcagtgcacatattagtatgattacacatgagtttttgggtgcatgcaaatattatattaatggatttggacatcaatcctattttggcaggcatccagatttcaaaatattctgttacatcctgactttcattcaatcaaaattgaatagtaaaattctttactgttctactctgtaagaagtcaggctaaaagtaaactttggctaattctcaccaagagttgaattagctgctgaatatgttgcatattgttttcaatgcaatgtacttcccaaggtaatcagcatgagaaagaggatatttaaaggaaagacagatgggatttatagaaatatgtcagggggtgagatttcagtcaatgtagcaggagagtgtgcttggcagtggagccaccaagaacccagggtgcatgtccctactgttatggggaggggcatggaattggattaaacataagtcaaaagactttttcacaaattttttctacacctttttctgtgtaacctttaaacacacatgtatgctccacttattaaaatcatctccatatattttcatacttgctaagtgacttgtgtgtcctaaccaagttcatgtatgactaacattagaatgggggccatatactaagacatacatcaaccaaaaaaaggttggaggtttttccatctgaagacttgtgcaaggtccaaaaagaagccagataaatgataaagggactgtaaacttcttcataaacttatatccttatggatagttagaattgttcttgctctagtgaatgctgtcctgccttgagaagttgtggagtttagtattgattattcccagcatactcttgttttaaagtttttattgacctgatccacaagttttctggcaataaccaatctctgtttatttgtccctatctaatagcacctgttctctaaggcttttaaaattagcacttaccttctttctacacggtagacattcttatcattgactacatattaactcaaggaatggttgtcgttttcagtatagtagagaaggctgggaagtaggttcggtggggagactggggcactgaaaagaaagctcttctattgtagatttatgtttgttaagctttcctaaattcttagaatctcaggcatatccatttgtaatggtaaatgtgtcatccactgccaggctaaatacagaaaactcacttttatccaaaactgataaaataaatattttgaattgttctgttctgtaattgatgtgaacagtattcttttaatgtcttccacaaaataaaaaaaatttttttctaagtttttcatgccatagtttatttaaaagttattaaaatattctataacatttttggaattgccaaatgattttcaaatttaattacattttggggagaggcaacgtgatgtaagactgagaacaaggtcaaacagatttcagattgattccttcctctgccatttactaggcaatttataatcccactaaaatcattctttcatcttgaaaagggagaggatgatgagaatgttgcaataattagagaatctatgtgaatgagtttttattgcatctggctcaagcttgaaacctagtaagtattttcattcttaatgctatcgtgcttctagatcatctcagaaggatattttcttcttttacaaaagtaaatttgcacttatgtgaatgaaaatgctgaatatgtgtgtgtacaccattatcaaatatatacacactatacacacacatatatatatatttatgatctaaatgctatggatcttttataggtagattattatagggcgttagatgaaaatgaattcgtgacaacttgactgatttctactatttttagatgaagagtctattttcacaaaagacttagagtcttgtttgatatgttcatggtttaatattctctttccagaagtttggtgcccaggaatgatttacttagaaattctttgcatacgggaacaggtgatattatttagttgaaatttaagaaaagttagttgagtgcataatcaaaaccgactttacatttgggaatgttctccagccaagctatgtattatctaactttaatattattgtaattcgtcatgcttactggttttctcaggtcaagacaaaataactatgtatcagattataaaagatagcaaatgaagaaaagggaggataaaagctatttttattattcttatccccactctctttttgatatgtaaatgaagattcagtttcttattccatctgagaaagtctgctctgaaaacagaaatgtgacaaatctgtattacgtaatcaagaacttgagtggcaggctgccctgtgatttattttcaaataatggaccagagagaccacttgaagttgcattaataatgcttgtacagggagaaataggcctttcttgttattggaacatgggtttacttttggcaagagttgagtaagtgaaaactctgatattcatacttacattaatcacatctcacctccaggaatggttttaatgtaagttaatcaatgcaaaacatggctcttttttttcacttcacatgttttaaaacaagtactagaagtctttcataaagcaatcctttaaatcaatgtgtcacaaatttgcattgataattcttctctcttagacacagaatagaagatgaggaactgagacaatgtttgaatagaggtaaaaatatatctttttgagaggaaaaaaaactgaaatccatgaaggattcctcaaatttagaataggtcatttgtctggcaaaattagtctataatttaaatttcctaggatctatgaaattatgaatagattttctatctacctcactagcttttagggacttcaagggaaaagacgatacgtttcacctgtatgtacttttttagagtactataaaacataagtggtccaataaataaagtgaacatattttgaagccaaacccaacatcttcatcagggttatttctttttttctgatcttaggaattgtgtgtaccctacttcttgacacccatagtgagagtgataggcatgtgtgaattgaaccagaagttgaaatgaaagaaactcccctccctcacatttatgaaggttgcttataattgctccaaaatgagatttgctcaactttaggccactgtggcatgatgagtggctcattattacacatttctatttgctcagcgtcagtatctctgcactctaggatggtacttctcgttccttcatctctctttgcatgaatgccatctccaaacccaaatccagttccctccgcctctctacatttctgagagccatcgtctgtctaagagttgattgactttctgagaaagaatactttgatattggctgggcacagtggctcgtgcctgtaatctcagcactttggaaggccgaggcaggtggatcacctgaggtcaggagtttgagaccaggctggccaacatggtgaaaccttgtctctactaaaaatacaaaaattagccaggtgtggtgccacatgcctataatcctagcgactcaggaggctgaggctggagaattgcttgaacccaggaggcagaggttgctgggagccaagattgtgccacttaactccagtctgggtggcagagcgagactccatcaaaaaaaaaaaaaaaagaaaagaaaagaaaagaaaagaaaaagaatagttggatattggtagcagcattgcctttctaaattatttccttcaaatagccatgacatgaatgataaatgatgataacattcagagaaactgttgtttcctaaatgtcacacctttgtattcaaatcaggaaacagacaatggagaggtgaagtgacttgtctaaggtcacactgttgtttagaattagaagcagtacttgattctgggtctctttccatctagccattcccagattcagctgctggtacaaagccttcggtggtgtcatggtagcacatctgccttccttgccgcttaagtataaccttaaaaaaaaaaaacaaaaaaaaaacaagttttaaaatgctttgtgtccataggcaaggctcatttgacatttcttgatttctcctttgtgatgtgctagttctaggtcagtggtccttagacttttggcacctggccaccagacatcacagaagtgcatatgcatcttctgtactttgccatggcaagaggttacacgcaaagccataatgccattctgaacgtaaactgtgaaattcactactccagtgaaatggcagtgccaccactacacaaacagagttgactttctcaagcttcccctcttacactcagcatgaataagcaactgctgatatctacacacagcatctgaaattgcaactcccagcaatgtagtagcaattgggtgaatccctcctaaaggagagatgctcttaacaactggggaatgcatgcaggtaaattttagagctttcttgggacattaatggaaacaacagacttctgatacactgggattcttggtaagaaaggcttctcccccgggcgtggtggtgggtgcctgtagtcccagctactccggaggctgaggcaggagaatggcttgaacccgagaggcggagcttgcagtgagcccagatcgcgccactgcactctagcctgggcgacagagtgagaatccgtctcaaaaaaaaaaaaaaagctatttccagaagctgattatttgtatttccagacagagttttcagagcaccaagttccaatacagaccagagaaatgattatatgctaaataaataagtccatgaggataatttttcagacacatgtaattatttttagtggatagacccagggatttctactcatttaacctgacgttaaaccctagaaccttgacatactagtttgagcaacttacccagcctctctgtatctgatgcttcatctgaaaatgaattgatgtttattttgcagaactgttgtgaggatcagcaatgaaataggtttactatccaagaggtgctgaaaaatggtggtgcttattatttggttattaatatgtgttgggttgttataccggacatagacagagcgatggaaaatcaaactatgttggatgttgaagttcccagaagttggaaacacagctttaaagcaccttttgtcattgtttgacattggaagcttaagggcatctttaatattgagctcctgttttggttggtatgcagattatatagagtcctcctgactccaaagcaaacatggattgggagttggttaagaagctgcatggcatccatttttatatttcttatcacgcagagaagttgacaaagtttatattttgaaaatggaaaactgaatatgcatttacttttctgaatttgttttttttcccttccccatccccatggttaaattccgtctcatgcttataatgtattctgcatttggactgcagcttcgttccttctcagagctacagttcttgagctgtaacagcgaatccaaaaaaactaatatggaatcacagatggtgcaaatatttgaaaatagataaatacaatctaggattagctgcttggactcagaaatgtcagcttcacattgcttattggtcacacaaggcaattttagttaaggaaaacacaggacaaagccatcatgatataaaattgctggtttgaagatgtgcagcataacaagcccataattgttatgtaaacctcaaaatgagtcattctgtaacaagaaaaaggtattttagagagatcacaaagcaccaacaggttatatagggctaaaaaattaagcagataccataactcgttcctgttgtacagtaccatctgctgacttccatttacagccaatttttaaggagaaaatatctgttctaatgggtatgctttaggtaggcacatattaaatgacctgagcatgagatgcaacagtcaaattgccagcgtaaaatctgcagatggtaattattagtaacatgcactgtgggctcatagttctgactctgagagtcttaaataatagaatcccattttctctccattatccccctttaagatgtacatatattctgaaggaatcttacaaccgactatgtgattaagttatctggtttactgataaggcagttgagaacgataaaggctgatttgctcaaaatcatacaactgatcagtttggtacagtagaaagaagagttcctcccacctaggttaagagttggtagaaggagcctcactcaattatcagaatcatagaaataactttggattgtctgtgatgatgtcgataaagaaaaaattgatgagaatgtaagtggaaaggttccagctggtttaggattttatttttatttttggtagcaggtttaataagaagatgtattgtatagattctatctgaaagcaataaggttaactatcatggtttgtgtaaagtctaggttttctgcagtatctcattttcctgatgaagtagaagagagtaggaagacccgttccagatcagacatgaagatctataagacagtattgatcgctttcaatgtacatgtttccaaatgagaaaatgtggttctcgtataagtatgtagtgaatatttgtcaataatttaacttattaaaggagccatcaagatggtaaagttggttcaaacagtatttgaggaagagagatttatatagtctgaaaaggaatggcttacaaagtttccaaaattaaatacaaaactggttaatattcaggccataacttttgtgtttgtctttgatagcagacagaaatttttgggtacttatatattttctataattaacatctaactttatagactgtgggcctatgtaatagcaaatagtaagagaaaatagggtacattcccctaaaattctataatcatatgtcggctgattagatagtgccccagtttgacattgaaaagatgaatgtatagttatacttgtttttatttacagttctcgaattgttttcttaacattcccaagctcagaaaaattgtgcaatctgggcctacacttgatgtcacagccaacttcttaagtcatgttattaaagttttctgtaaaccctgtggagcttccagtgtcagatttgattcaccagcagtgaggtcctggaatgcagccagtcagccaacattgcttgtcgggtttgtcccaagaaattgatgcaggtgtctatgaaggctagaggagaacaatttggtagtctcaaatagcttttctttggagaagatgagataggataattgcacacaaggaagtgagaaaccattcttgaaggatttagcaaaatgagattcggatcaagctgcgtggtggtagttgttcctggagatggctacttttagaaactgcccttagggagaagagagattaactaccaacatggtgtgatttaaggcatatcataaattttcattcccttgtgactcgcatctgtgactgtcagtgctctgaaaaatagctcttctcattcatctgtgtagctctggattccaccatgacttcctttgttcctttaacttctggctgggcaggggatattaacaatttatgtctaacttgtatcatttcctgctccgtgattgcttggtatgctctgtcttgagaacccatatttgggggccagagaagatgaaggtcttatgaatttaagaggggtgggggaacaggaagaaataaacatatgaatgggattgggaacctcaagagagaatcaccacttgcacatggggcaagctacttcccttcccttgccctttcctaccagtgttaaaaacaaaaaaataagtttacatgagtacttctgtgcagtgtaaaaaggggttcaatgaataatttggagtttaaaaaacttattgaataattgaaccttagtttcctaaaatatcttttactttctcacagaaaagaccagcgctattcaatagtacatactggaaagatgaaaatgttctgtattggtgttttccaatatgataaccaccagctacacatggctatcatgtttaaacacttgaattgtgacagtgacactgaagaattgtatttttaattgtacttaattttaattaatttaagcttaagtagctgtatgtggctagggctactatatattagagaatcagttttagaacactatccaaactttaatgtgggtatgaatcacttggggatattgctgaaaagcagattctagtccagtgaatgtgagctggggtccaagattctgcatttatagcaggtgcccagatgatgcctagtctgtggaccacactctgagaagtaaggctttatttctcaaaagcaaggattctctaatcctaatttatgtctttagccaggctgacacttgtcctagaggatgagtcagatgagcctgtagcaaaattacaaaatatgactttcaaattataaaaggaaagaatttcagtgacaaaattattagtatttttattattgacagtagctaaaattttgtgtctatactatttatatatgttgtatatttatattttatatattttataaaaaatttaaatatatttatatataaatatatatttgttatatataaacattttatatttataatatttatatatttatattatgtaatgtaatcaattgcttaaattttatttaatcctcaccataaccttatgtaatagattccacttttattccagttttgcaaatgaggatctgaggtttattaaagttaagagactcccaagactccacaggtagtaaatgcagaagttgtcttttgatcacatacagtcatacatattataataaccatcaacttctttcctgttattaagtggaggccaatgatttcccacttgcggctgatcaataaatcatatttgattcttttctacaaaggataatagtaagagccatactagtagttgtagtagtaatgctcactagaactctgtgtacaagttagaactgtcatcctcacttcaaagatgaggaaattgaggttcagagagggaacctctttggttacataatttgattacgaccacataacttgtaggtaggtggcagaactgggttttgaacctggattgtctgcctctggagtccatgcccttgtctgttccagtagacagtttctcatgtgtttggtgagcacctgctcccttaggcaatgcactgtgagcatggctactgccttctgtatattcaattgaaaatggagtttactttgaaaattttaatcatgtataattttatgtctatcaaaaatattttaagacaaaaagtcactctttattgtccaaaatgtataatttagtttgtagcatctttgaagccagtttttaaattcgtttgtcatccatgaagctgactttttaattgtgcatatttagttttagatcttacctccacttttttattagtgaagaactggtgagcactgtaagacatgtacatgtacgtgtgtgtatatgtgtatatattaatgtaaactttacaatttagaaaaacttaaaattgtcttccttgtctcccgtaatgaacttgaacgacaaattggcttcatcattttatgaaagagaaggtgaatgctttgctcccggtttttcagtaacctaagcatctgatttaagccttatttttcagaggtctttgtcattttgtttagttcggcagtcggtgctaacggagtctatttttttcacttccaattttaaataaaacacacaatcttctttaatttctgaataacatattcatgtagttcaaacatcaaatattacacaaatatatacagtggaacgtctccttcccagagttgttccccagctgtgcagctcctcattctgtcattcttttgataggtaatcactaatattattttcatttctttcttccagagaaatgtttgtagtttcaagctagtctagacacattctttacctctccttttataaaaatgttagcagacatgtttattttgaagtgtataacattgcttttgttttgttttgtttttgtttttgtttgtttgtttgtttgagacagagtcttgctctgtggcccaggctggagtacagtggcgcgatctctgctcgctgcaagctccgcctgccaggttcatgccattctcctgcctcagcctcctgagtacctgggactacaggtgcccgccaccacgcccggctaactttttgtatttttagtagagacggggattcactgtgttagccaggatgatctcgatctcctgacctcgtgatccacctgcctcggcctcccaaagtgacattgcttttttttgataaaaaccttgatattatcaaaatagaccctctaaaagttggcttctttaaaaaatgttcctccttttttcatgatgaattagatattatgtgcctcataatctgataagtgatagccagtcttggtgcaggtgtgtttactgtgcccttgcctacaaacagaagggaagagccatgctctccacacattgcctgacaaagagtaggtgctcattaaacacctgagacactgtctaccggagtagacaagggcatggactctaggggcagacaatccaggttcaaagcccggttctgccacctagaagttatgtggccctagtcaaattactttccttctctgaaccacagtttcctcatctttaaaatgagaacaacaaactaacttgcacacagtgttctaatgagcattattactaccacgactactatgaataccactactgtcatctgtggaggagagtggctactttactggtcaaccacaatcagcaaatcattggcctctatttaataaagaaaataaattgatggttattatgatatgtatgattgcatgtaacctaaagataactactgcatttattagctgttctgttttgggtatcccttaacctctctgaacctcagctcccaattagcaaaactggaataaaagtatttgatatgttggcatccacttcaatgctatatctgtgcatgtgtgtatgaatatgtatgtatatatacatttatttatatacatgctttccaacttaggatgaggttaggtcctgacataaccattgtaaatcaaaaatatcatcgggtcaaaaatgcatcataaattgaaactatcataagttcctctacctattatgggattgtggtttctactggatgtgtatggctttcacaccatggtgaagccaaaccatcataatcgagggaccatctagatagcattggtctacatatgttaatggggatcttaacaaattaaaagtagaaaagcttcctccttatccccagcattagactcaagtatgtatcccagcttttgcagattttaataagttgaaaataatgaatgagcctttcctagtagatgggtaaaagaaaagggctattattgaaatattctgaaacacaattctataccttataagatattcatgttaaggaaacaataaaataatatttagaaattttaatgtagaattgaacaaattccctctattttcttttataataagaaagattatattcctggatgtttgaatgacactgtgaagtctaaaggctagtaatggacataatcccgcattattaaaatgttgtttctgtattattattaaaaaatatagagactctcaatacatgataatgaatacgtggtgtgcttacgttttcttatataccgtgggataagcataatttgagaaatgagaggcatttctttaaacaatagactgtgctttattcacctgtcttagtctaaaaaggctatatgttgctgtcagtcacagcaaaccaccctctcagtgaataaggagataatagtatttgaggtaaggatagaagaccttagactttgcagaattcttttatgtttgcaaagaaaaattacctcgataaattataagcttatggatttttgtgtccttaactcctcatatattgaggaagctaagaattattctaaacttggcaaatttatttggtcaaaatattcctctctattccatcaagtagtaatggaatttaacaaacacaccaggaagaaaaatagcagcattgaaatgttttattgatccgtaaggatgaccagctctaccaagactcgaaaccgtttcacagaaggaatttttagttaaactattcttaacaataggaaaaacaagttatttcttttaagattctgtagagattatagagctttttaaaatcaaataacctcttttctctgaaaaattttaaagaaaaatcaattttttacaatacacctgctgaattattgcagggcatatttggtagctgctaatcttttaacacaaagaagaaacttgtagttgttaatgcttctaggaagtcaagctgctgaatggaaagtggtttttagagttcagattaggctttaatctttgatgtcctgctgggaatattaggagatgtatgggcatggttgaggagaggtacactgatagaaatcaactacgactttgataatttttttcaagaatcttattaagtaacccagacagaaaaggtacatgaaatgttaccaggcagattcctgatttcatattataaatactgaataggtatgacttgaaataaattttaatcagtcactacttacatattcgtacctaaaatttgggtaatggtaccatttgattctatcataaggaatcaagcctcttgtgtgttataatccaggatctttaggtcaaacctcttccttttgtgaattaacctgaaaatcctgtcagatcttctaattacggtgatatagggaagtttaataggaagtcaggattcccttgacctctgagatttcagtgtttggcggagtaccaagctctctgtttcaccagctactgcagagtcttatgacatacccaatggttgaattataagttatgcccctgaatacatctaaccatgacatcctctcactagaaatgtacatatgtatgtagatacccagactgatgctccaaggaaatgtttctagattgaaagggtgggagtgggcatgaaaaaatgtcctttctgcttatttatctcaatgtccatggaggtaactatttataatggaaggactgagggtaaccccaagaactcttgattataatgatgctctctccctccctccatgcctcccttcctcctgcctccctccctttcttaagcaaaaaagcaacaggaaataaagaagtgaataaaagttgtctcttttcctaaaaatatacgtcacttagtgaacacatctcacccctattttgatttacgaataaggacaacttaaaaactatcttctaatatgaaacaccttaacactaagaccttgcaaggtgcatctgttctttttatcctggagattaaaaaataatttacagacaaacagtttgggtgtgaaaatacttaaaatgaacaactttcattatcttttaagaaatcatgacggaagttctggtgaatgtctgtgctaacctgaagatattgagaaagtattttaggcagattctgttttatctgttacttcatatcatatcactcccttattcggtggcttaaaacaacgattttatttctcatgattctgttggtcaggagttcaggtggcttggtgggcagtgcttctggttcaagtgtgttgtttatcttgactgcattcatccggtagctggaaggtcaggaagacttcactcatatgtcttgtatattgttgctttttcatatgacctctctttctttctccacatgggtagtttgaacttcttcatagcatgggtcctagcatctcttaccaggaagttgccttctaaaagggattattccaagtaccgagggaaaaaaacccctgcagatctcttaagaatcaaccttaggagttatggagcctcttttctgccatatttccttggtcaaagcaggacacaggagcagcccaaatacaaaaggaggaaaaatgaatttcttgtttccataagagaaatggtaaggactgtgcagtcatctcggatccaccacagactatcattggctaaaacaacagaactgtatctggatacagacattcactataatagaagcatgtggatgatttaagaacgtttgaatgttaaaaatattataaggataaaagcgatgtcatgatgtcagtgctgtattcagccataatttttcaacacataccgttagccataatctatcaacacatgcagacaagttataatttatagaaaacagtctttcatgtgcagtgatgcttaaaaagataagaatttacattttcactgtaaaatagaaataaatataaagcaatcacctttatatagatgtagttataaaatatatttatttgagaataaatctaatgtaccgcttggttgaaaaagatggtatattccaaataatcttttcgcttcagggaaattatgaccatctagagtaattttgtgtcaaaaattaaaatatacagctagacttctcagaagatgtgtattttaaggaagggacaagtacacagaagttggttattatggccacaaagatactttagttgtgagatataattacattaatgaattctgccactgtgaaatccttgatgttgtcacatttcaggctggaagaagtaattgatctgggattggtgggattccaaagatttcacagaagaaagctttttcagatggttgggggaataatcagggaaaacagtctttggggttatcaggaatataatataattctctatgaaatatctttttaaaattattccagcccctctttgggcattaacagtgcatgaaagtatcctgttctcagtgatctaacctttttaaaggtactccaatgcaaaggactttaacgcaaagtgtagatactcctttctatggaatataaccctagtcatgacaagtttctcctttgtttactccttggaataagtgaaggtgatttaactcagagaggaaggtagggaagctatttcagaaggaagatacctccctaacctgagtgatgggggttacctttcctttgcttcccactcctccacattgcctgttttgcttaaaatatgacttcatccctttttcttcttttgttgtcatgggatattggaatgtaggaaccaggatgtcctgagtggtaaacttagctccactacctgagaaggacgatgtggcatacacccaccccatggacaacaggctgctgggactcctttttggaaacatgaaatatttacacgcacacacacacacacacacgtacgtgcatgcgcacacatgcacacagaggcacgcacattaactaagggaaaatttttactttaacacttcccttggaataataagccttgtagaactaattgtggccagattttattcaaagcagaaaataacatagaggaaaattacctactgctgtaatgtgatggttttgtactccaaaatgaacatgagaatgttcattcattttttagagataggttttttattcacggtataaattttgtggaaaaaaaaaatgtcattcttccaaactggttgtgacctgtggaatttgggaataaagccacgtgtgcattttaagcattcctaccttggtgctttgggttaaatgccccccagcggtcatccaatagaacctttttcttgcctccctcaggctttgaaattacctgtttactggtgtctctccatatacctacacatttcttgagggcagggactggactttcttcattttgaatcatcagtgaagagtttcaaaaaatatgtgtgaatttgcatttgtagtagaagtgctttgaagaaaagagagtttgaaatttaggagagggttccatggcaatctttattaagttgattggtatttataatatcttccagtctgtggatcgttttaaaggtatgctaggctagcaaagctgataaagtcagagtgatctcagattgacaggtgggataaataattagacttttggtatataactctcacagagaaaatctagagtgagttgatgcacagtagaaggaaaagagctctaaaagctagatcgaaagagctttttaaaaattaggaagagcaagcaaggaggaggggaatccagaggacaggaggatgtcagagggctgtgtttcatgggggcctctaaaagtgtccatggaaagaacgctagttgcagagctcctgggggagacaggaggagaggtgcacaagccaaactaacaggccagagtgttttgtttgcaacattagttttaactttaaatacagccagtttctttggactcgcagcccagacagggagagggaatagggaactcaacgacttcttgaataaacaattgcaagaaagtcagtaaaacccaatgagaccaataatgaccccacaaggtagggcctgatcctgtgggagattatgggtcagaataaaaacagttagtattttaaacgtgtgttcagtcatctgaatgatataaactttagctattattattatttcttcactataatttgtcaagtggaattcttttgctgcctgatgaagatgatttgtgcacttgagctgaccctgtattggatagggaggaagaagaggtcatttcaaatagaaggggaaagtaaagaaaagttgcgtgaatatctgtagaagacacgtgtgaaatcttatttcttctctttattggacttttacaagacgatggcagcagcagccagggatgcaacaagagtcacattcgctttgaaggctgcccttgaggaatggccccatttttcacaactgtacagaagtcatctctaggagagctgcagcaggcaaagccaagccggctctaattaatgacccaggctaatattggtctttgacgttcttggatattaataaatgttagataagaaaagcagctgtttatctctttgcccaatacaccttcaaacattcgtacaggagatagatatcctaatgtaaacatttgcagcctcacatattgtcgggatctctgaactgtgactgttgacagcaggttgccttaagtaattgcaatgagacagaataatctagtagaagctattgtcatcctaagtaatattttcctgagaaacagttatgaaaaatgaataatagcatttagtaatgcataatgtgagagtcaagaagaatattgaagacaaaggatacaatcatcattgcttgaggaaaactaaattttatatagctgtcctttgttgttatgttaatcaaattataaaataagcgatagtaggagaatagcattgctgtgttataaaattagttttagaattagattagttctgtgacatgagatggatcacagtgagattatacctcatgagtactcaactcttgtaaacactacaatgacatcgttaaatattccatgcttaaaacgcacagcacgttaactcctttatttcaggggttcgcttttatagttagagaaggttttttgtttctttttttttttttaacttttagactatacgcatacaatatattacaggtgcctgtgactcgctctaaaaatgttggaagctgaactgcatcatattcttgagggagaacttaatgtcaagaatttaaatttgcaacacccattaatgtgtatttagagcatttcaacaaagaaatacatttagtgacaaaagttttaaagtattacagaagagtcagaactgaaagataactcatggaattttaatgtaccattttaccaaatgtcctaaaaaatgatgagtactttcacaagtaaaaaagtacctaaaatttattattgttaagaaacattttatgtcaatctatgttaaaaccacaagtttgtaaatttctgaggaaaattgcattaagagtgtatggatattttaggataatgattaaaataatccaagagaaaataacataaatacagatatttaatgatatccaattcggcatagatggatgtggctctaattcagtgtggcaggaactccagaaagctaattttaacaaaagaatgtaatctgaacaatattaaacatgtaggtcactgtatttagagataatcactataattttaaacctattagtaaaggttgtaatgcaagtgtgttgtgctagagttctccaggaattactctcacttctctactgaaaaatattaaaactaccttcaaagataaagctgattacagcataacaaagcaactcactaccacctctacttcataataaatacaccccacattgttgtgttagacatgagtttcacacaatttattgattagttgaacttttaaaaagtctattatgttgacttcatgtctaacccttttataagtgagtggaaataagttcttttatttcttcccctattccctcactctcatcactgcggagctccgttgtttttattatcttattcattcctggtcttagttctcttagctttgttctgttttacgtgtaaacccatttctatgtggaagttcttctatgcagagagagcaggagtatattctttatgcttgggacaataaacatttatagactgaacattatacaccaggaattgtgctaattgctagatttacattgctggaggagacatgatagtcctctcagagcctacggtggaatacaaacagagcagcacagtgattttctgagtgtaacagagcatgcagtcaatgctctgggtgtcttaagagctttgcttagcttatccttggtggtagtagtggaggtgagtcaaagaagtcttcctggaggaggtgacctgtgacctaaaatgtgaacagcagataggacgaagaagggggaaggatggaaggtggtcatttcaagaagtaggaagcagcatgctcaaattgtataaccctcaactgtatagtatttgtggaaaaattataagcaatttatgtgactatcatatacagttctaggaggtggtgtgtgatgaggtaggaggagccatgtcatggaaattgttgtccttgtaggatattcacagcagcttgggctttaccctagaagatggggagacagttggagagttttaagtaggtaactggcatggctgactttacatgcatcattctgccagcaggacacagaaaggacttagaatagttatatgctagggtacagcctctagccagaggatgtcgacaaaggacctggactcaaatcatggtccacaattctgccaggttctagccctactgaattcagaaggtggtgcaaagattcttttttttttttttttttttttttttttttttttttgagacggagtttcgctctgtcgggcctgcggactgcaatggcgcaatctcggctcactgcaagctccgcttcccgggttcacgccattctcctgcctcagcctcctgagtagctgcgactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtgcaaagattcttacaattcataaagagaaacaaatccagctatggagaagaacttactttttagtatagaaactttcagatatttatggacatttttcatacatactaaatcttgaagcagagagcgacaaagacatacatttgtgattcaccagcatatacatggtcgtgaaaattgtgaaagtggatggagttttttaggcttggtttatattaatataatgggaaagtgatggtccaggacacctaggaagtttgggagttcaataacaagggaagaacttccagagagagctggaaatggaatctgtaaattttaaagcagctgggaagcagggatgaaatataatgtagtgggtgggagcatgacaaagctcagtaggcctggtgtggtggctctcgcctgtcatcccaccactttgggaggctgaggcggtcagatcgcttgagccaggagttggaaatcagcctgagcaacatggtgaaaccccatctctacacaaaataagaaaaaacaaacaaacaaaaaaattagcagggtgtgatggtacatgcctgtagtcccagctacttgggaggctgaggtgggagtatctcctgagccctgagaggtcaaggctgcagtgagctgagatagtgccactgcactgaagcctgggcaacagagtgagactatttcaaaaaaacagagagacagagagagagagggagagagagaggcaaagagagagagagagagagagagagcgcactcaggagagaagagaaatctcaggagagaagtaagtttcaagaattttgctgatcaaggaaggaggaagactaggaatggaggaaacatgaaattcagcagactaccttttgaaaatttttgttttatattatttgtatgcttttccttcgtattttttaggataaaaataattgaaagatgtgtatgggctacaggcaaagagctagttgagactaagattggaaatatgggagaaaacgggataattaaagaatcagggtcctgggtgaatgtcaggtaactggatctttctgtataaagaagtttgggctaatatctagaactacattatggtaaattttcacggaaattaactcagagggatcatttccagagtaattttaagcctatagagatattttaagaaatcaggccatattttagggtctctcaagaaaattcacagaccaggtcataaaatacaataaacgaaatgttttctaaccacacataaagatccttatacttgcttataaaaagagatataggaatttatactacactgcaataccatttatcaccttgagattggcaaaatccaaaagtagtgaatactgtcatgggaattgctgttggaaatgcaaaatgctacacctctttatggagaggaatttgacagtgtctagtaaaattatatatacttttaccccttgacccagcaatcacacttttagacacctatttcacaaacctattggtaaaaatatgaaaaaaaaaagcacacctaaggctgttcactgtacgtctatttgtaatagtgaaagactggaaacagttcaaattttctttaatagtattgttgcacatctatacaaatgcaatacttcacagctataaaaatgattcagaaaggtaactatactaaattttcatcattatatatgtatacacacatatgtacaaatatacaggtgctccttgatttatgatggaattgttataaatagcactcgaacataaatttaattttctcagcaaggcagttttacttctatagaagggtgtgacttgcagatggaacaatggcaagagcacccctgaacaagggaggggaaggcgttcttattctactgctgtgtcattcccctgttgtctagggttggaccacacagtctaagctaatgccgattggctatttttaaagagatcaggggtataagccggagtggcggggtgagtagtttggcaggaaggatggttacagaacaggtgactcaggatgagccgggacagagcaggcgacaaggggtgactcaggtcaaagcaggtgaccaggggaacagatgtgaactactgattggaactgacgggaaagttatttactgaaactagagccaaggggtgaagagaaccaggaagttaaactttaaaatggagcatcaaagaataacagagctgaacatactgacatactgattctttgaagagaaacttggggttcactatatttaacaatcccccatcttgaattttttcagttctttctcttcagacttccttaacatgacttggcttagttgttctgcttgattctctaaaagaaaaaacttctctgaataaggtggaggagaatttagaattaataatgtggaggacgttttagtaagtgctgcctctatgagtctgcgccccagcccacagatgcatgctatgacacaacacccgagaagaacgagtacaccttctacgctgcgagagaagtaagcatcgaggctatgattcctttccatttactgtaccatttttctagccaccctgtgaaggaggcatttactcctcctgagtttttggctaactccttggacagagcagttagaccttgcaatgcctttgttatacttccatcaggggtggtattgtttggatgaaggtgcaacattgagttttcatcatgaggtaaactcctccgctttctgctaatatcatgtctaaggctcttctattttcccaagccctctggctggtagcccctaattgctcagctattcctctaacagcatctctactgtagttaataaaccactgttggtagtaataaatgtaatttattcaaactatgttcttattaattgtcacccaccaaaatattgacttaaatcctgcagctatttgatcttgggttttaaattcatctggtactcctcgtggaactccaatagcatctatgtaaacatgggggtcaaaggacccatgtgaggcacttcttctacaatttttttttaatcatgttgacggaatcctagggtgaaaggcatgaccagttgaactagagcacaagtgctgctctaattactcggcagagtacccagcaagagtcccccgcaataccaccacacatctgctaggggatgaacaagggcagactggtgggtaagctcttggaagggcttggtttcactgcaccctgttaagtctacaaggaatactcgcttttcccccggcggtgaaaggcacctgttgaagttaacatcaggggctggaggccagatggccctcgggggctgacccacagggttcaacctcagggaacagcagtgaaagagtctcgcatgactcatcgccccaggctgtggggttttggaagagagctaccatacagctcatgcccggtccgtgagagaaccgcccaagtggaaaggggataatctgggtctctggcctgcctgtcgcacataacagtcgcttttgtttagcgtgcgaacagaatatttaatccattccagccaagcatttgtgtcctgatatcctgtttcaattgctatagtttgtttcaaatttttaacctctacagaaactactttggttttatcattgggtttataacaagagaaggtttggttagcggagaactcaggagaggaagaaggaggtgcaggaggtgaggaggcaatgaagcacatttcaaaggatcctatggggtccttccctgagacttctgctcctatactatagaaatggcttaacgaaggggaagaactctggggagcagagatggtaatctgtactgggttacagtgatttatctgaccacggggagggctaactcctttagtaaaatgaatatatgtggttttaagaaactgcaagtactagctggggcggtccatccttgctcttcggtgttttacagagcattggaccaacttcggcagagaagctctgctctaggaggacaagatttccagtttacactggaattttcgtcaaacacttctcaaactaacttgtcccagttcacagatttttagtctgaggaaagctaggaaggataaagtacttttctgaggtggagagttgcctctcacctggcaaatctccacagggtataacgaggcaaggatcaaatgtaatagtttgaggcagaattgacgtggttacgttaataagtaggtgaccagcaatagagtgaggaaagaagaaggagtaatagaatagatgaaagagagttacatttttcttagctttagtttggtagggttttcccctaggactatggcccatgacttgggagggggcggcgctttcttgacttgagtattatgggtccatcctttttctggtgtccggactgtggtttcggtagttaggagcactaggtaagatccttcccaggccggttcgagcttttccttctctccagctttggatgaggacgtggtccccaggctggtgttgatgtactggaaactccaggggtggcacctgtgctaaaagacctttagctctgagggaagagaaagtggaagataaaccaagtatataacttctgagaaactgatcttttgtttcaaatgtcgggagatcagtagtagaatgtagataaggcagtccataaagcatctcataataggataggcctatgtctttttggggaacagttcagactctcaacagggtaataggcctttctactttccctgatgaaggtgggtgccagggattatgatattcccatattatatccagtacctgggctaatttcttaatggcacgtgcagtgaaatgagtcctgttatctgaagcaatgttttctattaatctaaacttgggtataatattttcaagcaatgtcttgactgcattattagcagttgtacttggaaagaaaatgtcttctacccaatgagtaaggtggtctactattactaataaatactttagacgaccaattggaggcatctctgtgtaatcaatctaggtactttggaatggccttaagcctggactccttcccccaaggggtaatcttttactaagcaattgtctgtaaccatttggccagggtataaatctctatgcacccataaactctgaggactgcatcacacatggcttggggcccccagtgggtcccttgatgcagttggaacaagatttacctcataaggggtttggataacatttctctcagtctagcaatatccagtttccttctgaattctctttagtacctatttttattagtttttagaccaaagaaaaccaaacagcattttatatttgacagtgcttcctgtatgatttttataccagataagctaaatttcacctttatattagtgggctattaatgttaaactcaattttaataaaaccttgtagacatatttatccaattttaatgtctgaccataacataagatttttatagactctttttaaccctttataatttttgttaaagagcaggttagtgctttaagaaaaacccattgtgctttgattttaataaaaaattaaaataaattttaatttattttaattaattaaataaattaaatccttttacacggaatttcctttacaattaacgtttcaaaacttgcttaaactttaaaacaaaaaaaaaatttttaaccttttaatgtaggtatgaatccacattcttatgcctccttacaatccttttaccaaaagtatattttactttccttacacaccttgcaaataaactgtttcttcaatagttttacattcaggaggccgaattacttttaaattatacaacatttcttgcataaattcccttttataacatgtttcacaactttcacagacaatctttgacatgccttaactttttgacttgttgtaaacatccctttttttaaacaaccagttaatttactttcggacaagaatttaccatgtaagattctttttacatgaactctcctttttttaatgtcaaagatgataacagttcttttccaaagcaagcttcctttatgtctgtggactagactgcctaagaccaccagattagaagttaggataatacatgttacagtgttaacttttagcaaactttacttttgttgaaaacctgtaagtttgggattttaattaaagaaaggcttttctgatgtccagggccatggacaatagctgttccttttggcaagtgaagattatttatacgtgggtgattaattccttgtggaacaggtcttggtctttgctattaataagccctcattcagtccaaatttttccaaatgtatggaccactcaaaaggcgtacttagaatcggtaagatggttccttcctggttctctaagtactttaaatcttggctgagtgcaaacagctcacatgtttgagcagaccaattattaggcaattttcctaactctatttctacaagagtttctctatcaattattgaatacttattgtgtctttttccctcaatcacccgggaggaaccatctataaataagtgtcatccagtcctgaagggagtttctcctaggtctggtcgggcctttgtatggtaattaattaaatctaaaaatgtgtgctctctcttacgatttggatcccctgttaggaaacctgctgggttaagtgaattatcagtggttaatgttaaatcatctttttctaacaaaatagcctcacactttaagatttttgggtcagtaagctactttttggctttctgacttaggatagttctgaccttgtgaggtgtgctcacaatgaagtttcctccaaaagttatttttctactttcttctgttagcaaagccgttgctgctaccgattgaatgcatttgggccatctgcgggttactgggttaaggagtttgttgtttttttttttgagacggagcttcgctcttgttgcccgagctagagtgcaatggcgtgatctcggctcaccgcagcctccgcctcccaggttcaagcaattctcctgcctcagcctcctgagtagctgggataacaggcatgcgccaccacgcctggctaattttgcatttccagcagagacgggatttctccgtgttaaggatttttgataggaaggctacgggttgccagtggccttcgtgcttttgggtaagtatttctaaggctacgcacttgtttacactgacaaaaagatggaatggctgcttgaggggaaagctaggacaggggcagttactaatagatgtttcaacctttccatctgttggatttctggtaatggccaaacgaaggggtttggcccgtcttgcgtgagctttttgtataaaggctttgtttttagggcataagagtctatccatagacaactgtacctgactaattctaaaattttttaagttcacagtgttctgtgaacatttgtggaatctacacggcagaggactagaatggacatttatgagtgatgtttaacataacaatgccacctgttggatacagtaggagattactctgtgtttcatattcttagacactgatctcagcagacacagaatctcgggtcccctttggaaaacagcattttatgaagagcctttgatgcattatgcacaggagagaaatcgtggcggtgaatttcctagtgttgggttttgcctgtcagataaacttaagctgggacagtgtcttttgcagatttggggatatattttggacattcagtgtgcgctcatgatgatcactgactggacaaacttatgctgatgagtcagtattgttattagaagatgagaggggctctgtaatttgaaatctattttctactcctgagacattgaaagggattccaatttggattcaatgtgggtggctttcaagatagttcttttaagatcatgtgatctttgcccttctcacagtttagtgttgtctatttttaaagggtgttaggagtaaatgttgtttatgtttaagcatgataatataaccatacctcaccgccacccctaaaacccgtagagacgaatacatgatagggattgcaactgtggaaggtaaacaaataagcaattttgctcatttgttttttaaaagtgtgactatttgtcttgatagtaataccttgagcttgtgcttcaaaaatctgtccagctattctcttctgcagacatattcacactctcaagcctgcttctgttaatgtgtttatgtgattgttctaacacggtgaatactgcttttgactatatgtacccagaaattattattacatttttttgtaatttacagaaattattattactttttttgtaatttagataacgaaccaaacttgtggaccttttttgttcatttagaagtggtaaaggttgttccgtgccttgacagaattcttaacagctgcctctgccttggttttgctttatgcgcttccttccctcaatggccatggcattgtatttcgggacactcttccctccacaaagcaacagggcaattcttcagtggatattagaatttttctcttctttttctgcaaaccctgatgcacccatacacagcatatcttttgttttattacttccagtttggtgaaaaactggatttgtcatgacaaccaagtatttagtggaacagaagcagagataaagaacacatcttgaaaggaatacacaggatcaatatttcatgtccatctgaagtgttttcagtgttgttgaggaaaaagtatacatctcattgaagtgtcctttttttcccagggaccagatgttcattttatttatcaattgtggacaatccgtcaagcccagcaatatttttccagagatttccccctgtggttttctaatttatttgatatttaggaaaagaagaattgcagctgctgcagaagaattagagttcaacttacgtgtatgtgatcattggagcatgttcctccgtcagacattaaacgtttaacaggacacagtaacttatgcttcgtttgaattttgcatctgcctgcttctcctaactgggtgaagaatgctgacaatgacctactggattagttattcctctcctctattttatgaaatatttcatattttatatttcaaaatatgaaagcatattttaaaattactataagactatatttattttagatactctccacataattagtattgcagagcttcctgcttcaaaatgtatttgtaatttttttctaattgcactgacccataatagctaagattgaacctacatttaaaaaatttaatttcccttcatgttagtgggtaactataaccataaaagagactctttttttaaaagattggacttttacatttattaccactgtaagtgcaatgagataaggcctctgaccatgttcttttggagattgttaaggcattcatgaatcctttggagctgtcagcctgcacttctcactttgtcagaacatatggatgtgtgggtgtggtatgcaagctaactgtcctgaagaagcttgtcaaagaaatgtttggaggaaaaaacaccataacactgagcataagtttgaatatagccatatactagaataaaatatggatatcaggaaagagcttcctatcagagattgctaacattggaacttaaattgcatcttgaaaatggattaataaggtttagcccagtagtggtaagttggtggacattactagtgggtaaacattacatgggcaaaagttagtaatggaatattgaggaaaggagtctgggctgaggaaacgaaggagtaggcaaggccgggaggggtggctcacgcctataatcccagcactttgggaggccgaggagggcggatcatgaggtcaggagatcgagaccagcctggccaatatggtgaaaccccatctctactaaaaatacaaaaattagccgggcgtggtggtgcacacctgtagtcccagctactcaggaggctgaggcaggagaatcgcctgaacctgggaggcggaggttgcagtgagccgagatcatgccactgcactccagcctgggtgacagaatgagactccatctcaaaaaaaaaaaaaaatagaagtaggcaaagaggagaatggaataactggagttgggaatatggactcataaacttacctttaggaggagttactaggagagtttcacatcagcagtggtctaatcaaaaaagccaattaactccagccatttttagtcactgtaatttggctccaaattcaagttttagggtaagatatcttattggctgtatcttcaagttctttaagcattgacatcagattttctgtaacgcctttagagcctgctataaaccctaatagatgactttatctgggtagctagaatttgagatacctgtgaatcttggctgtaaaatttgactcaatttgcatcccatttggatgaagcaacaggatattagggttttgaagtatgcttatgaaaataaatatgctatgacgtttgtaattggtatgattcagaatttaattagataaactacctagcatttctctgtattttcagaatcttattaccaacttttgtagtactccccaaagagcaatttcagtaatttgtagtgtatctctggacgtgataaatgctattatatcactgtgatttgtaatagcagtgcttttcactgtgaaagatttactgagattttctaattgacttagagcattgcctctcaaactctttctctatttcttattcactgtactttctcatcacaacttagtaatcatattaatcttgctttcttggaaatgattcatatatttgcatgaagactaattaaaatacatatgcctgtcctaaatgattaggctaagacttaaatgagcaactctcagcttaaaatcctccagtgattccccagctcgctcagagtagaagccaagcctcttataataggtcgtaacaccctggtacttttctggattcatctcaaacaccctcttactaataccactcagctttatggcaccacttttggttgtggtgaaggcaccaacaaaaatgtttattgtctgaatttggcatgtgtgtgtgtagtagtgtatgtactcacatatctgaaaaatatttaccctttaatataactttctgtcactctgtatatacacctccagattcctccagttcagacatgcatttgcctttgctgtttcactggtctggaattatcttctctcagatttcttcatgtgttactccttcagcttcttaaacacgttgatcaaattacttccagtgattctttccctagagggatttacttaaaattgcatcactttttacttatttattctcttcattgtttgtgtcttctctctgctcatccccccagccccacccagacttaagatcagtgaagaagattttttttcttgttcctttacattactaaatctccagtgcctatgtcaaactccagcatggggttaataaatgtatgtagaatgaaggaaagcctcttccaaatgagtgcttaccatcattattgcctctcaagaagtagatcttaatatgaaaaaggatgggaaagttctccttaccttttcttctaattctttgccatgcttgaaacattaaatggaaccaaatttctagatttatttctatttacatctccaaacatttgcaatccttataaaaaacatggtagaggctaatcatgataatgtagataataatagtagtagtaataataatagctaacatttattgaagacctattaaagttcagatataacttttattatatcattaacaaatgttattaatttaataaaacctgtaattaaatttttaacaaacttcaaattcttgatgagcaactgagttgataatcctatttgcccattttgaatatgataaaaaacagccacacttacagtaactttatttatttgtgtgcatattatgtatgcattttttctgcttgggatctgttgtgtatttgtatggggattttagtatatgtagtgtagagactatcactgtcaggtaaattctgttatttcttttggagcctattggcttttaagcactcggcatgaaatatatatttcaaataactattaagttgttatcatctgacttttttaaaactttctacattaagggacttttcattaccttatttgaactactagttcttggtttgaatgtaacaaattcctgggaggcccgttttgaccgcaaagaacaatgtagcactatcttttttaaaataacatacctacttaccaaaagaattgggagaagaaatcttgattcatttaggattagactaaaaagttacattactttttcttttattcattatctttttgtttatagcatgtatcaagactgaagagatgatgattttaaaaagataggcattgtattatgatttgctttttcttcactgtttttataggatgattaaaaatatctggatttcataaggcataattgacaggttgcagatctgagttggagcacatatcaaataatatataaaaccttctgcttgatacttttgagatcaaacattgtcataacacccacagtgttttaaaataggccagaggacagcctcctggatagctgacctttaaccaacaggaagtatataaaatatctgcagagtagaatgactatattccaaacttagattagacagaaatgacaccagctctgggttccatcactgtttctgtgcatccgttgttgcatctgagaagcagagtgctttttgttcccccacacttcatctagtttgaagcaagaaaatttaacagtgcaacaaaacgaactgccttttccagctgaactctatcttctctgacagatggttcggttgggcgtcttttccatccagagcagtgctgtgtttgaagaatgaaagcattgagagagatcatttgttgtatagagcagagtttcaaataaccattactactggcaatctctgctgtaattcctggattttgagataggtgtacaaggaactctgtggtgagattaaacattcagctaatttttttttcccccaaagtcattaagtagctagcatttaattttttatatgtgcagattaaaaatgaaggttaagtaccaacaaaggaagctccgttcaggaaaactctggtatactctttggtgtctttggtggaaatgactattcattatgcggaagaataagactttataagaatagtatttccctaagcaggcacagcacttgagaaggttacagaatacctgtttactctgctaacctaattctctgtcgatttctcttgtcaatgccttttgatattttgacacagaatgttctacctaggaccactctgctgaatataggtcaggctctggactctttctgaacctattctcataaatcgcaattttattactgtttatacttgtctacttgagtcattccacacaatgggaacttatttttaatactaatttaaaccgaggtgctactgagtatcttgcttaacatatttgcagttcctgaagacttcagagttttatcccaaagaaataatgctcatagagaggaagcagatatactagttattccttggaagaggaagaaaacaggaaatggatatttggaaacaagagagacttccatgttcctcaattcatagcaattatccagtcctactttggatcatcctcctaatcctattaagaaaataaatgagactccaggcattacaaaatctgaaaggtttttagaaaaacaagctactctgaaagcgtatctttggtcaacacagccaaacacaactcacagttttaaaaacacagaaccggccgggtgcagtggctcatgcctgtaatcctagcactttgggaggctgaagcgggctgatcacctgaggtcaggagttcgagaccagcctggacaacatggtgaaaccccatctgtactaaaaatacaaaaattagccgaatgtggtggtgcatgcctgtaatcccagctacctgagaggctgaagcaggagaattgctggaacccgggtggcagaggctgcagtgagttgagatcataccactgccctcaagcctgggctacagagtgagactctgtctcaaaataaaataaagtaaaataaataaaaacatagaaccatttggtgattcctttagagacaggtcggatttttcacatcacttcgcagtcgatgaagccttaaactaggacctactaattgtgtctagacataaacagaagaggaaatgagtccaacaagaggaaacaagaatgattctttgtcaagtacactatttcttttcaagagctcatgttatcctcaagttatatggaaatcctttcttgaaaaatgactccacctcctgctctgtatgtgctcccagcccctccttccacagtggagcagtaagagagtgaaggctttatgtgtcctcaagagcaatgattttgcaaattcagaattgctacttcctcaggaaaacttgaagttaaaaaaaaaaatccttatttgaagaaggaaaacattagggcattatcgggtgagaacgtctctcatttcctctcacacattagggtctttctttgaaaagtagtgtttttatgtcttaggatgagggtactgcatgattcagggttctcaattttgtgttaaattaatatctgtgcattcttaagatgctatttatcaaggtggttttacatttgatcagaactcagccacagatgcattttcattatttatttttatagagatgtagtcttgctgtgttttccatggtggtcttgaaatcctggcctcaagggatcctcctgcctcagcctcctaaagtgctagaattacagacatgagcacccatgcctagcctacattatataattaattaaaactttaaagcaataaaggctactgaattttaagttaagcaattttctatgacctagaaacataaagtaaaatcactctagtttgtcacaaaatgaaaaatatatgctaattaagaatcagaaaatcatggctttatggaattgaacatattttcaatttgctgattaaactccctgggaattttaaagtcatctaattcagcttcttattgagaattttctcttttaattggacagctttggtctaaatacttccagtggacctacttgcctctacttttcgaggaaagtctatatcagagacacttgtattattttaatgtgtttcataattttgagaatacaaaattggattctgcatagctttacttgcttttcatatttctctatgtaatggggatatttttgaattctagagcagcactgtccaatagcactttctgtgatgagtaaatgttttatttctgtttaatatggacatgtggctaatgagcactggaagtatggctagtgtgactgaattactgaattttggatttcatcaatttttaactaaattaagttgaagtagccacacaagtcttccatatcggcatagttttagaaatattgttttcatcaaggacagagaaagaagaaaatacctttctcttgtttgactgcctaatgggcaaaattccttttacaaacgttgagaaacaaacaaacaaacaaaaaacaacaacaacaaaaaatcttttggagttaatgcttattttgcatagaaataaaggcataaaggaaatttcaatatatggccaactcaagtttagaaaacagtcagctctctatggtaactaaccaaggaagagatgaataaggaaggtgtagaaggtggggaataagacctgcttaccagcttaaggacaactgaaaaatgacaagaattcaactgccgtgtccaagacaatgttttctgcaagaatgagtggattttaagtacaaggaagagtgttggcttgagtctggtcttactatgtttttccctctccaaccttattttttcccaggttgttgacagtgtgtaatttcaatagatgctcggcacttttctcacatctccactggagatgagctttatacaagtgaaagtgctactgagatgggaagatgttagataatggcatacgtgcttcttttttaattttttctatgatttgcctccattccttaggtcagcatgaacagattggagagggagatgctgagtgtgtcatactgaactgagctaaattgatcagaactaagggtgatatgctcccaaactactaccctatcctatttacagcttcatctaactagtgaagtaatttttctacctcaggaaaattaaaaagatccacacatacacccccacacccagacatacacatagacacatgcacacaaatccatgaagttggcactttggctttgacctctcatgatcttcttgacctctctatgatctgcctcagcctcattttccctgtccaaacacaaaatattttatactatccaatatattttattatggattttttcttgttaaatttccttttctcctatctattcaatcaaaattctttccctccatggagaggtttccctaacaatagacttctacctaattttcatattaaagtaacttatacttagttgtgaggaagttctctaggttaagaataaatatcatagagaaactttattgtcaaatgaatacctaaatgacaaatttctgtggcgatgggcgagtttaagcagaagagactccccctcacgttctatgaattttcttcagttatcctgatttgacttgattttaggctacttgtgaagaaatagaaattttactaattagtgaaatgtcttctacagttaaaaatccattaaaccttttctgtctatttctgatgtgcagttctgcaaaaactgggccctcttaaaaggctaagtgaccgcttttagtttaggtgagatataaaaacacaagtagcaaagaaagtaatttacctttgtctagagaatttattctctaaatatgcacaaagaataggccatatgtcagactttgtccttagaattcacgggaagaaggaaaaagactaagcctctagcctcttgctattgacaagagcaatagatactacatggattatatagaccttgcatgcagttgtgatgaattcgttgatagtaacagaaaaaaaaatagccttttgacaatgccagcactttacaaaacattttagtcacaactctaatagcaaaacaaccactaaagcagatgttaccaccctcattttagaaatgggaatctgaggctcagggaaatggcctctgtggatgaaaactttaggttttgttcctggcagtagtaacaaaaaaccaaactcactaaacaggtcataaaagtaaggaagcaactcagtttcatctgtctgcctgttctgtcagatagtgacagctcctcccgtggggagcagtgaatacatgagtgagaagactttttaataacagccattctgactggtgtgaaatgacattcattttggtattgatttgcatttcgctgattagtgatgttaagtattttttcatgtttctttggccacttttatgtattctgttgagaaatgtctgttcatgtcctttgcccattttttaatggggttgccttttgctttttgatttgtttaagtatcttatacattccagatattagatctttgttggctgcatggctagtgagtattttctcctattctgtaacttgtctgtttactttgtatatagtttcttttgctgtgcagaggctgtttagtttaattaggtcctacttgtcaatttttatttttgttgcagttgaatttggggacttagtcatagattctttgccaaggccaatgtccagaagggtatttcctagattttcttctataatttttgtagttttaggtcttacatttaagtctttaattcatcttgggttaacttttgtatatggtaataggtaagaatttaattttattcttctgcatatggttagccagttatctcaggatcatttattgagaagggaattttttctttattacttatttctgtagactttgtcaaagatcagatggttttaggtgtgcggtgcggcttcagttggtgggaatgtaaattagttcagccacagtggaaagcagtttggaggttcctcagagaactaaaaatagaactacaatttgacccagcaatgccattactttgtatatacccaaaggaaaataatttgctctaccaaaaagacacgtgcatatgtatattcatcacagcattattcataattccaaagacatggaattaacctcggtgcccatcagtggtggattggataaaggaaatgtgacacatatacaccatagaatattatgcggccgtaaaaaagaatgaaatcatgttctttgcagtaacgtggatgcagttggaggccattattgtcagcaatttaacatggaaacagaaaatcaaatactgcgtgttctcacttgtaagagggagataaacattgcatacacagacataaagatgggaacagtagacactgggagctggaagagggggaagcagggagtggtacaaggattgaaaaactgcctttgaggtcctgtgctcactacctgggtgatgggttcaattgtatcccaacttcaccatcacacaatctatccttgtaactacctgcatatgtaccccttgaatctaaattaaaagttgaaactaaaaatgagtaagaatctgaaaagaggaggagcaacttctcacttcagggaagctttcttatgggagtatgttttatacacacatatacatggtatgtatatatgaatctgttttatgaacatacacctatttccttacggactatgaggacaagaaaatggtgtttccctcgtcaggtgactgggctgctacttggatttatgtttggtaaatatgttagtgtgagataatgtaccatacgcctccagaaaccaattttttaaacaatctatagcaccataaattagcattttctagtgtgactttcaaatattaattactattctctgaaaaaaagtttcatgaagagagttcagttcacagagtccaggtacatgtgagaaactgccgagtaggttccttcctcaaaactctgagaagcactgcaatagaaaaaacatttgattttgcttaaagcaattttccccatatttgacaacaaaaccatgtctatttgctttttttctcttccaaagtcaagctattgacatatttgttctacagaagacatctgagaagatttttattaaaccaaataaatgagtaacatggaaaatttgagcatcatagtgggattagagaaacatttttggcaggggatgggttgtgggcaaccattttattattccatttagcttggtttactcctctatttattgatgtctggtactgtaagtgtataattatttagtgttcagtaaatgctaagccatattaaatggtaatggtaagattaagcatgtgcatgctatttgtccaatctagatacaggctaggctcaaagtatgatgtaacttcagccatgctgagggttctataggctttaatattcttcaaagatgttatcataagacctaatagaactagaaacagaacatgaataaaccaatatgactgtattggagatttttccgattgtcaacaagtgtttcgttgactgttccagacttttaaaagtgctgtaacttcaacatccgaatctcctttttgtgtgcataataaacattcctgctttgtgtaattttaactagaccaaacgatgcttacacttcccagataccagctgttgaagcagcaactttcaaatgattttgcagatcggcaaacacattatatcattgtgtgttttgcagctgtctcttcagttagcctggttttgctttttgcagagtaacttgtgtacagttacagaagagtatttgttttcctccaacagtcttggcaattagtgctttcctagcttcagttttactttggtgcaataggcaccctgtattgtgaaccgtttataaaccaaggtaatgacttgtgggtttttaaagagtgcttactgcaccaaaaaaaaaaaaaaaaaaaaaaaaaaaaaagctttctcctggcttgagtgattttaaaaccgtttagtcaaatgtttgagtgcctattgtgtttaaggcactctgtaagtgttttgcatccactgagcaatacatagtagaagttagttgtatcacacgtagatgggaaggttattctaaggaacaccacttttcaaacgcaagagagcatgtccctgtgatgccacagagggaaactcagtgagactagagcagagtacaaaatcagagtatcttatggtaggcgtgcaagaagtagattgcagaaagctatgctaaagagtttgtaaccgaattgaatttggaatgaatggaaatcctttggaggattcttttttttttcagggttatgcgaagatcagatttgtgttcttggtgaaagatcacacagtatagtagagagaatgaactataggcaatcacattgggtgcagggaaacgagtaagcatactattgcctagttatataacaatagattggcaaaactggatagtagagacagtgagtcctagttagttttcttaaatgaatctattagccgatgtacagatattagatagaggacgatagcattttagagctggaaaatccactaatctaagcccattgtccaagatatgaaaactaagtcttgggccaattgaataatcttgataaaagctttaaagctagatagtatcaaagctagaatcacaatccacatctctaaggatactttgctttacattatttctctttttttttttttcttttttttttttgagatggagtctccctttgtcgcccaggctagagtgcaatggcacgatcttggctcactgcaacctctgcctcctgggtttaagcgattctcctgcctcagcctcccaagtagctgggattacaggcatctgccactgcacccggctaatttatctcgctatttttattttgtattttattaactttatcattgagccttaactgcatagattaaaagagtaacttcttttaatgtaattatacattgctaaaatgaggtctcatagcagaagagaaatgtttaatggcagcttcctttacctcttgctacttgactttgagcaatgcattcctttagactcaaaatctgctttttattatttaccagtctcccttatctgcattattcagtgtgcaagtattgatttccacttatgttccagggactgtagcaggtgttgggtgaataatatgtggaaaactctatccttgaggctgttatggtgttggagaaatggacaaggttgtgggtggctctgcaaccacagtggcaggacgtcctgcccttctggggagttcaaaatggctttctggacatgaaacttgattaagagcagtgccaacatcatcgtttcaaattatctggaagtgtacatttaggagcaaatgtacaaagctataaaaatattcataattcttttttacacctaatacttgacccttgtgcttggctctgacgtgcttactctgaaactcttttgaaattggctttgtgtgtagacaacagatgagttctcagatcagaaagtaagtaaactggcatgatgttggattttggctagctctaactattaagtagtgatgacaagggtactcagctctgaagcatttattttttattttagatgacactatcttaatctcaaaaagatatcctttgacttgaacacctttcctcaggtttaagctgtaatcaagttaaaaaaaagtcaaacattctcagtttcaggaagatattactgctgtctaaaacctactaaaacatattttgcctatccaaaaggcaaaatatgtctctgaagggaacatgagcaccttggcagaaaatgaagctatttataaatcttattttctttactctttcattccttagttgtttttattggtcatatttaagatatggacatttttaatatatgtacactcacaaacatatatatgcacaaacatacatacacatacatgctatgaaataatctatagctaagtgaaacatgagacatctcagcatgtgaaactgtaataatctcattcagttaccttttgctaaagtagactttattcttttgcatttctattatttctttcttattacttttctttgtttattctaactttcttgttgtctgccttgctttaatcattttgtttcttctctttatctcctgagcaggcaaacaaacctctgggcaatgtggtcttgcagctcagaacagcaaagaaaaaaaaatatttaactcgataactgcaaagaagaaactgtgtttcctgggagaggaattattgccaaagtagatgcaagaaaaatcagctctggcagagacaaggaagaattacacatatgtcttaagtttatacttcctagatttctatcacaatgatagtaacaaagatgtgaaacacttcatttctataatatcttaagtaggccaggttcagtggctcacgcctgtaataccaagcactttgaggtggaggattgtttgaggctaggagttcaacactagcctgggcaacatgagtcgtcttctctttttatttttattttttatatatattatactttaaattctagggtacatgtacacaacgtacaggtttgctacgtatgtatacatgtgccatgttggtgtgctgcacccattaactcgtcatttacattaggtatatctcctaatgctatccctccctcctctcccaactccatgacaggccctggtgtgtggtgttccccatcctgtgtccaagtgttctcattgttcagttctcacctatgagtgagaacatgtggtgtttggttttctgtccttgtgatagtttgctgagaatgatggtttccagcttcatccatgtccctacaaaggacatgaactgatcattttttatgggtgcatagtattccatggtgtatatgtgccacattttctttatccagtctatcattgttggacatttgggttggttccaagtctttgctattgtgaatagtgccgcaataaacgtgtgtgcttgtgtctttatagcagcatgatttataatcctttgggtgtatacctagtaaggggatggttgggtcaaatggtatttctagttctagatccttgaggaatcgccacactgtcttccacaatggttgaactagtttaccatcccaccaacagtgtaaaagcattcctatttctccatatcccctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccactttttgatggggttgtttttttcttgtaaatttgtgcgtcctcttctctattaaaaaaaacttaattagagattctaatgatacagagaggaagatcaaataagtcaaaacaatactattgagaaatattcaagacatttatgttttaaggtaatttgtttattttgccaaaagcaatacataattatttgatcaagcatataaatctgcttcaatttttgtattatattttaaagtttaatatataacttgaattgtgctactccctgtgaagttttgctaaaatatttaattattattttacaaaatgtattgttttgcaaaatgcaaaatctttttctcagaaagttgagttgcttacttagtttcttttgttggtcttactgatttttttttttttggtcacatattttagactttgtgtggcccagatgataagttatcatttctcataggaaatcatatggcctaaaccaaaataaaacaaaagaataggaagtctgtgagacaaaacatggaagtcatttagcatagataatacctaggaaggcctgaataaattgccattggttacttcttaccagtcctacaagttttactgtttctgcttatgagagtagtcatctaccttccatcatcaatgcaggcatatattggatttaataacatttgctcttttgcctattgaattgtattattgctgacatcaaaactctcctaataatgtttttttttcttttctccttaaaatatcggctctgggaggacacttacccaattttctttcatttaatttggcagtaagatgctaacggtccttttttattgacagaagcaataacaattaatacaacttcagtgcatcattagttgacatgttttgtccatatattgtttcaaatctctttaagaaacaaatgatatccatatttgagttaaatacaatggtagataaactaagttagagatgtgtgcgtgtgtgtgtcagccaatactttgagtgttagaattgttttcctattcattattttttgaataaacaagtaaatgctagttaaagctatttgatgctgtgactgtttagctccttatgcaaaagacaggtcaacacccttggatttgttgagttgactgtgcattcagcattatgcaaagcaatgacccagggtgcatgtcttagctctgaccttaacctgcagttacttctcaatgaagctctgatgcctttgtcaagtacttgtactttatccatagattagctaattttcaagttgtggggttaatctttatctgtgttacctttaaactaaacacttactgttccctaaagcactttagtgctttagagaacatgctggagtgaacctccctgcctgaatctgttatgtcatgacccttcattacagactcttttgaagatgtgaggcagttttatattaagcaaagattatcggagcagcctgctttatggaaagaatcaacccaatgtacatgacatgcaccagtgtttctctttgccaaagggaacacactagtcactcacattagagatggccttaagttactatagtcaaaatactccactttggtctgtattttctttaattcagtgtaaacttttgtggagcatacatctgaaaagtccatgctggcactcagagagttactcttttagcgtatgagacagagtgatatatgttgcacgatatttttgtgtttagaatggtcatctatggaatgagattacagaaccaattttctttaatttaaaagaaaaaaagtatttaacctacttgaaacacatacaaatatgttaaaataaataaaaatagttatttatgtgtatttgcacacacaaatagataaaatattaccttgacatattttattatagcataacttgcatcagtatatgtgtacatatacatattggggcatatttgttcataaattcttaaagtagcctggttatgcatgctctgtcttaaatgagtttaatatgtcattatttcactttgagaaatgcatagttattcacattggtttatcacatatggagttgaaagagtctattttacttctctttcaggatcatacaaatagttcatttatataatcacaaaatggagatccactccatgattggccctgcccattaatattgaattttcatcacgctgttattctttacgtgagttcttaaatataaccctggtaagggctataacatgtacatttgaaaggattataaactgtgatagtagaaaattctgagagaattataggaaagtcttcactgaggactcactggagatagctggggtgtatatctccccttgccctaggaggatatcttgcatttttactttacatattttgtctcagaatgagtaaaagacataccttagagtaggatgcaacagtgttctcggatagcactaatttagaaaaaaactgggattgtaaatgcaaatgtattagagaaccattttgcaaatctcttgcttgtaagaaattccccatatttttgccccatgtcacccatccatggtgattaatactcatccttaagccttcaggttttgtcttatatcaggtattcatggaacaatgtgtgtttactttatctatctccatcctgactgatcatatactgcttaccttcgctctttttagactaaagtctttttcttttctatttatttgttcctctgacactatttttctatgcaattttgtttgagcctttctagtaggggagaataggtctacattattgtttataatttcttgtgatcattccttgattttgcttttagttgtattactgcagttaatatttatgtttactaatatgcatatgcttaatcccaaatgatactaatatgattcattacagtgtacagtatgtcaagatgactggcaggtatctgattcctaagtactataatgagaagcttaggcctatagtacttagactactgttatttcagtacctactacaatcagtagatttttaggcacatttaagagatttatacactgactgaggttcctaagtcactgtttattttatggaaatagaggcaggatttatggatagaaaaaatcagaaaaatgctttttttaacccataaaattagagtaaaataatttttataaatctttaatatttagactttggttttgtagataaattctgtgtttgagaaacaagcctttcgtgggttggggttgggaagcagtcctggggaggaaacataatatcctggcaaatgcggccagtggcctggagagtgccatgcaaattgagaactgagagcagttgtggatgtggaatgaataggggtttggtctgggtgccaagtcaatgtaaggaatgaaagctacatcccatgaagatagtttagtgacaactctggctttcagcaagttgatgaaaagctttattattctaattctgctgcaattgcaggagtcccttctgtctgggggttaagcttacccaagagtgttacttcatttccaagtctaagcattaggttctgatacatggtatgaaattgttaaactctgtggattttaaatggccttttgaaattatctgtatcaaccgaggtgatgttaagatacactgagatcattttcaattaattgtacttcagccgatgttgagagggagcaggtagggaaatattgatcaatattgccatggggtatacattttatatatgaaataattacttgtgtcactgaacatgtgtttgtctcaaagccgtatgaaattgtcagaatctgtccttttttctgacttctccctttattcaataacactcaatgatcttatatcattcttaatgtgagattgacttttgtctctaaggaatgtaaaagttagcctgattttctgtatcaactcatcacaggcactggcattcccatacctctcttccaactgagttcttgcttgcttgacagaattgtgagccccttgcttcctttgacccccaggtttcccaatccactcgaattgacaatgcctttggctctcatttttttatcctagcacatcttgcctttcctgagcttgctgtcctgttggcagctagactgctgtctttgttgttgataggacacaaattgggaaatacagggacaaaaattttaacctgctccattacccaataggtttggttttttaaatctgtatttttacttcatacaaggtaatttgcgttgtgacatacctatatggtaatgactgtttggtgggtattttcaatgttgattttccagagttgtcttagaacaaaagtgttggcattattctgtaggctggtaaatacgttgtgcttccatttatgtggtttcaaagcataacttatgatatttgtccaaatgaagaaatatctttgtttgtttttatccagcaggaacttataacttatttcaataatgaatttttaaatttatttgaccaatatgattaacatattaagttctgattttaacaccaaaaaagaaaaaataaaataggccatataattttgagcatttgtgaattttatggaaatactttaagttttaaagtttttaaataggccacatgtctagtattaaaaatagttcacatgtctattattatttaagtcaaaaattacagaagtgggcaaagatgtggagaaaagggaacatatacatcattggtgggaatatgtattaatgcaacccctattgaaaacagtatggagaaaaattacagaagtgggcaaagatgtggagaaaagggaacatatacatcattggtgggaatatgtattaatacaacccctattgaaaacagtatgcagattttttcaaataaccaaaaatagaattatcatataatccagcaatcccattactgggtatccacccccacagaactaatatgatccagcaatcctattactgggtatctacccccacagaactaatcatggtatcaaaaacacctccattcatatgtgtattgcattactattcacaatagcaaatatatggaatcgtgctaaatattgatcaaaggatgactggataaagaaaatgtggtgtatatgcataccgtggatactactcagccaaaagagaatgaaattatgtcttctgcagcaccatggagggaactggaggccattatcttaagtgagataactcagaaacagaagtcaaatatcacatgttctcacttatatgtgggcgctaaacaatgtgtacacatggacagaaagagtagagtaacagacactggagactcagaaaggtgggaggatgggaggaaagagggagaaaaaattacctaatgggtgcaacgtacactattcaggtgatggttacactaaaagcccaggcttccccactacacgatgtaacccggtaacaaaactgcgctggcacaccctgaatctataacagtgaaaaaaaatttaattaaaaaagtaggccacatgttgtttcagctgatgtttacatggaaaaatttgaatctcccaaggtctctggagagataatggaacttcaaacatttcagtgactgattttataaacgcatatgtacgtaagtgtgtatgtatatatatgtctaacttagcataatcaaaaactaagtcaaggctgggtgcagtggctcgtgcctgtaatccaagcactttgggaggccgaggcaggtggatcacctgaggccaggagttcgagagaagcctggccaacatggtgaaacctcatctctactaaaaatacaaaaatcagccaggtgtgctggcgggcacctataatcacagctactcaggaggttgaagcaggaaaaatcacttgaactcaggaggcggaagttgccgtgagcccggatcgtgccatggcactccagcctgggcaatggagtgagactctgtctcaaaaaaagaaaaggtcaaaagctaagctatatatatgtatatatacacacccatatatagacaaatatatgtgtatttggacatagacatatacgtgtatatatgtgtatacgtatacacatatatacacgtatatatgtctatgtatatttgtctaacttaacatcaaaagtatacactacaattttaaaagattaattacagcacacacgtcaaatagatatgtgttgtgtgttttagacttatccttttatctgtccgataagtgggtattcatccagaagacctaattcacatattaatttctcatcttctcacagataattgttttcaccagagttttaccaagacacttcataattaggagtaaggaataggttttgaacattttagttttgaatcctacgtctgctaattaccagctgtgtgaacttaggataattatctaatggctttaaatcttaatttcttcatctgtaaaaggattaaataatagctttctaataatactaaatgaccctttttgtgagtgctagaagacatcatacatggtaaacacctaaagagtgctcgccacataaggctcattcaatattaattctgttttcgtggatgatggttattatcaccgttgactcaagagtttggcatttttgttttaatcatttgcttcatggctttacttcctttacagatagcaataattggctatgcatcgatctttcctcagaagctagcacatgtcagaaacatagtagatatttaattaatttagggtgaataaatgaagtatgccacttctttacaaaatgccaccagtgggacttgccagatacacatatgatcttattttacttcaatttcatcatcacctgttctaaagcatctgatctcccgcacatgaaaattaagctttttggaaaatcacaccattgcggttggtactgattgctttgcccaaattattttgtcttccaaaatacactgctgattcacatcttttttttcttttgctcatgtagttattgattacttctgtctagaattgcccttgcctgacttacttgtctgattcacttactttttcaaaactcaactccagtattgccttatctcagaccccagtctaggcttagatgctcccacgtcatgctctgcttcacctacttgtcatatgttatgtgacctttcctgtcattaactgattttgtctcttactcatgagattgtattcttttcaaggatgagcatggtttcagtgtctcaattatgaatgttttgccagagagttcttagttccttactaggattcagtaaacatgtgttaagctgaactgaatattgtatatagactgtacattctcaatacagtttcttgacttatattcaaaaggacaatttttatttttgcaatggcctacataaaatgcttctttaatccccttgtaactttgctgtaaaaattgaactcaagagataagtagttttgaggttttgggaaaggaaagaaacaacgatttgattcttcttgaagggtgatctcttgttacatatttttcctatgattttaatgagtgtattgcaaaaaagttctgccggatccttatattttctagaaaatctttatttccttactcctacttctgtgttggtttccttaaaacatgacatttgaataaaatttatgccttaggaaaaatgtatttcttttaagctgtaaggtttccaacatcgtactgacatagattcaaaggagaggttccatgtcaaattttgtacttcaacaagatcctgttccattccagttcattgcatcaggctatagctttcatttaaaattttttctttgagaatgctgtgagtgaaatgtgtggctctctttccataccaggaaaatcctctatagagtagtgtatactggaaagacttataataagatatactactgatttcccatgtctaacatttggttctctgatgtttatgggctctactaatcagccttgtggtaattggttttctgaccataatttgaacagaaaatattactgaattaattgtttttaattgaaggaaagtcaatgtagtttttataatacatttttactaagagggaccaatatcatatgttcccattggaattagactcaattaacctattagtgttagatgcataaatacccatcctcatacccatcacactgagtacttattacaccctacaacttttgtttagagatagcatgcattatcttatttatcaaagtatctgaagtaactatggttatccttattttataaataataaacagaggcacagaaagttcagagttacatttgaatgaaataacatgttaaaaaagtgaaaataggttttaatttttcatcccaagatggtaaacacatgctcataacataggtctgcattgacctctctatacctggaggctgaggttgagcaatttatatttctagaccaaaattctcgaaaatgaacaaaattatattgcatttatttccctgctattcattacataataggaacacacttaatttttgtacatgaatcatgagcatggttcaagatttccagctctgactctaaatacttttccataatcatcctacttctgttccgtaagtgtatacacacacacaaacacacatatacaaatacatatgtatacacctccactcttactactgttctttctttgtccgtggtgctgaaagcaggaagctgttccataaagaataatgacagaaattataacaataaaaggtgctgtacttatcaaccatcaaaatgatgttaatcatatattgtgcataacatagagatatttgtatttcttggtatattaccctaaattctcaatataaagatcaaaagaacttaataattaggagaataaaataatgttaaatattgttagtcacactttgagaaaccaaaggttaaaagactagccaacatctcacagagagctttgaattgattgcagctgactgcaaatatgctgactaattatcatgccctttaatagtactatcttgcctggcttttatgttagcctagggaaaattgtcatggaaaaatgtgaatggctaaatattttattcaaatttatcacctgtcatcaacaactagaaatgtatgagccagttattcacccaactacatgctgtggtaggatgatggcagtgattataacaaaaactactaccatttactgaacacttactgtgatctttataagggtcagctaacttaatctttacttcaacctcataaaaaataaaattcttattttggagttacagaaccttttacatggggagatttagttgcctgttttccttggtattggagcagagttactgttccaaaccagattatctacaccaaagtctatgctcttaatcattattctgtatcacctgcttcattttatacactcattgttggtagctatcaaaattgtaggtattgtattgccatgactgaagtctgtctttatgagtcagtgtgaaacagtgatacaaaaaatagtatatttccaattagttacctcgtgtagatcttccgtgtgaccttacgaaagataccttgagtttaatactatcctaagaaaaataaattcagggtcagcatggtgtctcacacctgtaatcccagtggtttgggaggctgaggtgggaggattacttgaggccaggagtttgagaccagcctgggcaacagagtgagacccccatctctataaaaataaaaatttaaaaaaggaaaataaattcagaaaaaattgtaccacaaagtcatttgtttgcagacaattatgtattgtgtagatataaccagtctttgacagacatgtcacttacactttggaaattattagacttgcctaaacttgtagttcatttagttgatattgctgaaaacaaaacaaatcactactgtgcctttgatgattcttgagaagttcaaaagggaaatacaacaataatttgctactgctgtgccatgcactgcactacatagctcacagaatttacttttaattatcatataccttttgctctctatttcatatgtatacatatatattcatatatcatatttatttttatattcatatataatatttatatgtaactaaaatattatataatcagtggcgaagccaaaatggtaatcagtgtattttgattataaaacattaaaaatattaactatatcagaagttacaaagtgttcaattcagtacaaatgcaatatttgttgcatttatatttccactttttttttgcccagagtgtgtgttttgtagatgttgcagttgttagagtttgtccatagtatttttgaattaaagtacgtcacaaagaaattaagatttttttctcttgaaatattagccatctggctgtgttaggctcatattcatgcatagatgtattgactaaatctaggtgtactttaaatgagaatgttctctttagggtagtgtagtccccacctggctcacttcactcatttgtgttagcatatgttccctgtaggaattcaggtttgttgcttttgcgttatactcaaatgcactaaagcagggttcggcaaaccatggctcatgcggaacagcctatttttgaatataagttaaggatggtttctgcaccattacaaggtaagagaaaagagagttaataataaaaggggatgtgacagtaactatacatggtccgcaaagcctaaaatatttactatctggccctatatagatggctgacctcttctttagagtattttatgggacttgtttattctacactgcctctgactctttgaaaaagattggtagcattattcaatacaatcatggacactagaagagattttttcatggcaattagcctggccatcttgggcaaaattagagcctttgaggctttcatgtttgtttctgtttttttttttttttttttttttttctatgagctaagagaaaaccatggtctataagatatttctggaagcaaaactaataaccccacatggacagctgatttctgtgttacttctgcttttaaagccagattgggcatcaaaggattgcctgaactgttcatttggagctatttgtttgaagctgattagtgaaaatgctaagtgtgagtaagcaatgttacttaaactctaggatttggagagttttttcaccagaggaatctgatttagctgattggaagggtacactgatagatttcttgttagtaggaatttaggaacacaggggagagcaggtttagcaacacaggcatgctgattatgaagcgtggtaccacttacgggggaagaactctaatatctttagagtaaatgagtaaagagggcctggagatgaatttgataatgtatacctcacccaaaggtactaaaatagggagaaacatagcaagtagcattgtgctcacccaaccagaggcatctctagctcaatcagttcagccatgacttctcattggtaatttgatttgaatcataattgatatgatttggccatgtccccacccacatttcatcttgaattctcacatgttgggaggtaattgaatcatggggcaggtcttctcatgctgctttcctgataatacataagtctcatgagatccattggttttaaaaagaggagtttccctgcacaagccctcttctcttgtctgctgccatgtgagacatgaccttcaccttctaccatgattgtgaggcttccccagccacatgaaagtgtaagtccaacaaacctctttcttttgcaaattgcccagtctgggatatatccttatcagcagcatgaaaatggacaaatacagtaatctttgactattagagtagaagacattcaaaagcattttagtgcatcttcatctcatgaacagcattaaaaaaaagcaaataaaatggtcataaaatttaattaatttgcccaaatttgtcctaaagagtcagcattagtatctagatatcctattgcaaatttggggctctttttattacattgtctataattccactgacttttttttctaaagagcattattaaaaaaatcagttgccgattgcttttgagtagcataccgaaagaacaaaggtcttaggattggataatcaatgtaatgaatatttataagactatttgtaaatggattttgactaatacaaatagatctggtagcaatattgtttcataacatatatctgtgaatggtgttttagtatcttaggggttggggcttccttgctgaggactcagctaagtaagaaagccagtgcattatttttggactcagaatagaccaatgtgaaggtattaacaagagtaaagacggcaataagagggttgagctattttagcttttccctcaagtaagttttaacttttgcttaaaaacattaattttaaggatgtctattttgtttttgaggccactgtgccaccaggttatttattaaaacaattaatgattaatttactatttttctgccaatgaaagagctaggattcataggtttaattatggctgtgtcagttgctctttatggaggctttggcaagtaatttaaattctgaatctaacaaatttcctaagaatggattaactagtagttctaggtacatactgtaaagtatatataggaaactaaaatttagataagacatatttggtttggcgagctgtaaggagttaatagttttaataaactgtgttcaggataatgtgagtgtaagatatgttcagctgaaagtaaagaaaatgattaaacaaaaatatgaaataaacaacaacaaaaaggaacgagtaaacgaaaatgcagtccagcagcaacaatatgctagaaagttggaggaaaccctgaaaaatggaaagctgttgggaccagactaatgggaaaaagtactgaaggggaaagttggaatcttttcgaagaaaatgattaatagcatgcacaaagatgtcctggaatgtttatcacatcagtacgagtcatagaatttggaagcaaactttcctttcaccaacacgtcttgttttaataaatcatgatatatcaatactttggaacattatgtagccattaaaatgatgttactcaattatatctattcatatcaaagctgcaaaatcacacttaaattattcaataaaaatttatttagccccttctaggcattggacactattatgtgtactagaggttcaatgataaactcaaagtagtcctgctttgagtttattgtctattaaatagaaaacagtcatcaggtacatatgcagattagtgagtgtaaagttacaactgtgaaaacattcttaaaagcctcatcttaaggaagtgtgcaaagtggggtctggatctaattggggatttgaatgggctttcctgaaatctgaaggatgaaagaattgagttaactatgtgaaagttagggggtaaaaatttaagggaggggagaaaaaaggtcatatgaccatatggatttttgctccttagaaattgaaataagatttctgtggctggaggttagaaagtaatctgtgaatgtaggataaagttgaatcagaaaaaggaatattaaaaatttgctaggtgagtttctctaagtttcctcatataagcgagatattattcacagaagcagtgagtagaatggtggatacctggagctggagggaaggtggggaggttggggagatgatcgtcaaaggacataaaatttcagttagaggaataaagtcaagagattaattgtacaacatggtgattgtagttaataacaatgtattatatatttgaaaatcactaacagtaatttttaagtgttctcatcacatacacacaataatcatgtgagataatataattgtaatttgttaaatttagcgttatacaaggtatatttattttttaaaatcatgttatataccataaatatatccaattcttgtctttttaaaaaataaaattgctgggtgacaaatattgaatgcttaccgcatgttgaacattaagaatgatcacactaagaactctcaatagcttttgagacaggtatgagtatcatttgcatttctccagataagtacactaggatgaaactaaacccatgtcacacagtactgccagagctagggtttgaatccagactgaatagcaatcactgtgctacactcatcttttgggtaggagatagtccataggtctattttaaatgttctggattttgatttttatcctaaaataagataacaagcattggcaagttgccatttttttgataaattcttaaggcatttgtggggaggaatattcaagtggagagaaagagaaagtaaaggaggccagcgagaaagctattaaataatgcagaggagaggtcatgatagctcgctccaagagggaagattagagatggagggaagaagacaggttgcagagacgcagaacaggtgaaattgcatggtactccataatggacctgctggggtgcaacgtgagaggccgatctcaggtctgtgtggaggatgacaacctgccttgagataggcagcactgaacaaagggcccgatgactatgagtgtgttctttttttttcttattgagtgcttcgaaacacttatatattgaagtcaaaccgcatgaatgtgtgtgtgtgtgtgtgcgtgtgtgtgtgtgtgtgtatgcatgtatatctggaactcagggaagtttactgagctggggatagatttgccaatcatctatgggtagttaggaattagaactatgggtatcaatgaagtttcctagggacatacatgaatgaatagagatgaacataataaatcaagtattaatagtaattatttctctgttataattataggtattctttgtgctagttttctttatttgtatttttgttttactttaatcagcatatattgatttttgtgggaaaaaaattgaaaaagattttttttttcaattgagaagaaaaagtttattgtatatggcaaagggtagaggagaagagaaccaagatggacccggggttttgtgtctggatcaaaaggcttttctcctctcattttgcactgtttaccccactcagtttggcgctaccttttattactcactagcagtatcatttccatcaaaactctaatttttaaatattttttggacagtaatgttagctgttatcagaagttgtcaacagaacttaaattcaattttacttatactttaacatacaggctgcacatgctaaatgcttgtcacttagaatgctgttctcattagtctggattgcagattttgttgtcatgatgatatgtctggcaacattctcatagtgggtgagctcgactgtctagggattatcttctattacagttcagtttatcatgctctgtttgatatgttctttattaagaaacttaattacctatagttctagatattatgtgctaatgagttgtacgtgtgagtaaatgtattccgaactcatttttggctgctgatatatttctacaaagatgctttgagaaaaagaagcgataagatctgcttccattcttggtcagaaaagttgccacttagtcataatgtggctttattccatgtttccatgaaattcatttgagacatagtaaactcatatttttgaatttaatatttgtaagcacactgtcagttatccacatagtcaagtaaaacttagccgtgaacaaaatctttgaactgtaatgtcatattgtgtcaggtaatcttattcagctatgaaatacttaatactttaaaaatgacactttattgagcacttctatgtataacagtgtttagtaaaatgtttattttgactacttactatagttacatcaatttggtatttccagcagtagtcagaggaagcacaatttaattaaatatgtggatggagaaaattgatttcagagcaaagtttcttgtttcagattacttgtttggatctcagattttgcgtgttgttaagggacttacatttgtataaccaattgtaataaatgaagatttccatgaggcatatggttgcattcatttcggaagaactacagatttcaagtaaaacaaaacaaaacacagaaatcactgaaccaaggcacatttattgagtacagacatcaaacaaatctcatttttgtattaaaatctaaaaattccatataaatagctatgtttgtaggttgttctcttaggctaaaaataaagacagatattgcatctttcatcaacctaacatcaagatatttgcgtgggaccaatcttctcaagatttgattttaaattgttgcttagtcttattcaaattgcatgtatccttccctctcaaggtacataaaatgaaatgttctgaaaagacaattatgtgaatatgggagattctagggacttacagactctactaattttagcaataatttttttctcatagtgaggtccattttcagagtacattaaatcatgtatgaatagtcttcatctttcagtaaagaaactgattcttccagttgaaatttaaactttcttttactctctttttcttttttctgttgtcaacttcattgaaatgtaatttgcatacagtgaagttcatccttcttagtgaacagttctgagttttggcagctatatatatctgctgccactattaggatacagaatagttagcccaaactccctcttgccccactttagtcacctttccttgactctcactctttggtaggcgccaatatgttttttgttcagatagttttgctttagcagattgttatataaataaaatcagacaatatgtagcctttcaggattggtttccaaagttcatctaatgcatttgagattcgtgcatgctgtggtgtgtgtatcagtctctgttttcttttaatgcagaatagtatcccattatatggatatgccatagtttgttcagccattttatgctttctttttattctcttttttcaaaattaattatttatttatattaattttgtgggtacataatagttgtatatatttatgagatacatccgatttcttttttttccttttttttttttttggagacagggtggtagtctgtcacccaggctagagtgcagtagtgtgatcgtggctctctgcagcctggaccaccctggactcaaccaattctcctgctacggcctcctgagtggttgggactacaggtgtgcactattatgccttgctgatttttttgtgtatttatacatatattttttgttgttgttgttgacatggggttttgcaaaattgacagactggtgttaaactactgggctcaagtggtctgtgtgtcttggcctaccaaagtactgggactacaggtgtgagccactgcacccggccctatacatggggtacaggagatgcttgatacaggaatacaatgcataccagtcatatcagggtaaatggggtgtccagcaccttaagcatttaccctttctttgtgttacagactataaaattatactcttttagttattttaaaatatagaatagattattgttactgtagttaccctgttttgctatcaaatatagatcttattcaccctatctaactatatttttgtacccactaacaaaacccgcttcaatcccccctccagccactaccacactaccattcccagcctctggtaaccatcattctactctctatctctgtaagctcaatttttttttaaaaaatttagtttccacaaataagtaagaacatgtgaagtttgtctttctgcaccacacttattccacttaacataatgacctcctgttccatccatgttgttgcaaatgacaggatctcatacttttatatggctggatagtattccattgtgtataagtacaacaatttcttcatccactcatctgttgatggacacttaggttgcttccaaattttggctattttgaatagggctgcaataaacatagaagtgcaggtatccctgtgatacactgatttcctttcttttgggtgtatacttggtggtggggttgctggatcttataatagctctatttttagtcttttaaggaacctccaactgtttgccatagtgcttgtactaatttacattcccaccaacagtgtacaagggtccccttttctaaatatccttgccagcacttattactgcctgtcttttgaataaaagccattttaactgggatgtgatgatatctcattgtagctttgatttgcatatctctgatgatcagtgatgttgagcatctattcatacacctgtttgccatttgtagtcttcttttaagaggtgtctattagatcttcgcccatttttaattgcattattagactttttccctatatagttgtttgagctccttatgtaatctggttattaatctcttatcagatggatagtctgaaaatctgttcccccattctgtaggttgtctcttcactttgttgattgtttcctttgctgtgcagaagctttttaacttgatatgattccatttgtccatctttgctttcgttgcgcatgcttgttgattattactcaagaaatctttgccaactacaatgtcctgattcctcagtggtttttgtttcttgtttttgtacagtagtttcatagtttgaggtcttagattttagtcttttatccatgtttatttgatttttatatacagatctagtcttattctgcatgtggatatccagtttctccatcatcatttattgaagagattgttcttaggacctttgtcgaaaatgaattcactgtatatgtataaatttgtttctgagttctcctattctattctattctattctattctattctattctattctattctattctattctattctattggtctatgtttctttttatgccagtagcatgttgtttgttcactatagctctgaagtataatttgaagtctggtaatgtaatttctccattttttcttttcttttctttcttttttttttttggcttaggatagctttggctattctgggtcttttgtgattccacgtaaattttaggattgtatttcctatttctgtgaagaatggcattcgtattttgataggaattgcactgaatctccagattcctttgagtagtgtggacattttaacaatattgattcttcgagcccatgaacacggaatatctttgtatttttcttgggtctccttcagtttcttttatcaatgttttacagtttttattgtagaaattgtttgttctttttgttgttgttgttacttcctagctattttattttatttccggctattgtaaatgggattactttcttgatttctttttcagattgtttattctgggcatatagaaatggctattttaatgttgattttatgtcttgcagctttactgaatttgtttattagtttgaatagtccttggtggagtctttaggtttttccaaatataagattatatcatctgcaaagatgatttgacttttttctttccaagttgaatgcccttcagttctttctcttgtctgattgatttagctaggacttcctactttattttcattttgtaggtagtatttctgccatgaacactaggattatattaacattttaactagttgctgttgtatctacttttattttattttagaacttttccaatgagttgttatgattgtagactttctaattgaagagctttttatttattaaattatttgtaaacatttcaattgtaataagtattgcatttaatgaaaaatgaattgctttagaaaatattctattaaaattctagagatatgttaatgatttatttgttgtattttttggtatgctttttccggtaaaaaaattaattatgaaaaattggaaacaacagacacgtataaggaagaaaaatccatagtattctaacatggctcatagtttgctggaaagtaattacaaattttttcagtctctaatatctgcaatatcaatctcaaagattgagaacttctggcacaccatagttggaaattttaaaagtaaagccaaaattagctaatttagttaagtgagttaggggaagcaaggtgaacctatggagtacagataagaaaacacacttcagtgttcaagacatcaaaaagaaaaaaaagaggaaagaaaaatatatttcattatttgaactagattacattcttccctggagttccctacttttgttatcctgcataactgtgttttaagtagggttaaaactaagatatttcaaattctgtagtagaaaaaaaatagtctggtattatagattaaaaaaatgaattaaatataattattaatctaagttatgaagcctaaaaaattctaactcatttgtttaaaacacgaatgtccatattcttttactttattccatgatatatgaaagtataatagcatgcattctatttataaacatctatgtttatcttaaggtacatatgctaatgaacatttacaaattgcatcccttacattttgctatgaagaatttaaagcacatactttacagtttgattcatattaatacttaaggtctttttcatacaagttgtacctacattaaaaattagaaggggtcttagaagtcatcttagtccaagtaccttatttttctggagaagaaattcatctcttaaatggttagtgaatagaaaagtttaaatagatacaaggatccctagtttcaatacaaaataatttcgcctataacatcactgggatgcaatgaatctcaccaaaaataattttctatatgtctgtttgtaacaagcgttagcccccaagtattttaatcaagaagtagcgatatatgaaagaaatccagtcttgtggttcactcttttctgtgactctcaccatttccctccctctatgctcccaccacagtatttgggatcagctccaccttatctcttgtcaggccagtacttctcacaccttagaggatatgagagtcatctggagaatcagtaatgagcacaaattagaatagggcctgggcctgtggatttgcaccaacttttgtgggtgagttttatgccccctaaagaaatcactggtgtagactcctgcatgtgcttccacataagccccttcctctccagcctttctcattcgtctcgaatcaagaggacgtactttggctggcacaagccttctaactgcctagtccattgtattgttccaaacaagttaatggcatgcactgaactgagacacactttccaccttggcatcggaaggctcccctgtaacattctagcctgggtctctactccagcatgactgaactccggccctttaagaggaagcattaaaagtgtgatttctgttctcagaaacttgagttaagcttatagttactactaagagaaatgttctgagcttcaccatttttctggaaaaaaaaaaaggtttttaggtgctttgaatatgatacataaaagctgggtatgggggagaaggcacttagcaaacttggggatgataatatgataggctggtcacctttctgtttaattattttgcttacaatgtttcactgaccataggttttgaacttatacatgcttcaatcttcagttttgatttcactacttccttgtgccttctgatttcccttgctgtgtgctttcttactcttctgaacatgtatagagttgtcatatagccactggaaaaaaaattctgccatatatgagtgctcgtatgcattctgcattatcctcacacaaggcaagggagctgatttcatttccttttgtaatcactgcacatgacaagttcccaaaatacatattgaatgaagtcaatgaatacacttattttgaactcttaatctttataaacattaatattttctggtaatcataataacagctgctgtttattcagtagttaacatgtgccagccttggtgctaagtgttctgtgtatgttattattatgttcttagaacaactaccccgagatgcaagtattttaattccatttcatgtatggggcagtttgaagctcagtaaaaaaataccttaatcacttgcaatagctaataaggactagagttgagaactaaatataaactcctagcaactttatcgatagtgtctatcgtcatcttaatcttgactgtagattgactgtttttgaatggacttaaagtgacagcaaattagtgaccaccatgtcatattttaaaggcttacaatgaagtaatttattctgttatataaaatagaatgatctttcatctaaattagagaagttttgcaattgtgtaggtatattgagtgtgtgtgtgtgtgtgtgtgtgtgtgtttattacatgcagttcaagggaggctaggtatatgataatatcttatccaagaactgttcccactgtgcttcccgaaagaaaaccgtctgatttcatgtcatttcaggcactttgggttattttaaaagtcttatctagttttttaagacatggttctagaatgcagtctaagaatgcagtcccgtgtgtgattataagacctctttctcccttccagtctttccctggttcagaaaagacttgactccataggcatcatttggagctggagaagacctgttcttttcccatcgccttcatgtgctccttgctttccccctggtggttctactttatagaggacattcaaatgggagttcactctgggatccattggatagtttttcttagggactctgggtctcccctagagtttcctggaatgagcacttagtctctgcaaagaaaaattgacagcagagtctgccacaataaaaatttctactcaagtttgtagccctcttgtgggcgtggacaggatgatactccatagaatttccacagcatccttttcactcatggaaaactcactcacctttgccacaccaaatgtgggatgcaggcttttccccatcttccacacacataccccatttctgctcacctgtctctcccttagcccttcttctgcccagtagtatcaggtggatttaaagcttagaaagttctagaactaagagataaatcagccttcaaaacagtaggaagttaaatggaggtagtgggggaaatgcttttcaaggtacctttatcttgaagaaagggacattttaataagcaatagaataatgatgaagaagtggttgtattccctcaaattcacttattcccaagttttatagatctgtgtttattatattttttctgcagcccacacttagaaataatttttgcattacaatcaagttggctctctctccctctctctccttttctcacacatcacatacctgaaataataatagtaaactcagcattcacctattttatataccctgcactatgtttccttttcttcttctatccagtactatcagtgtttaacttgcttgtttcgtgacccacaaaactgattagataaccttaacctttgcatgcgtcacgtttcacaatttataaagcactgctgtagaaggtaaagactaataaacgtgttggttgacctttcttcccttgtacaaaggattctcaggtcaatagctagattttactaaactggccctgaaaattttataattttgattctcaatagcagttttctgtactctagtctgtgagttactggggaacatttgaaggcaagaagaatagcagttaatacggcgtgccaccttctcaccatgcacactggattcgcaggtagctgtgtatgcatgcacttacatttcctaaaccagttttattgtttttcctgaacatacatgcttgttgtttaaaaaaaactgttctgaaatatataattctttctcattcctgcagagtaatcactaattcaggtcttttttaagtcctacttaatacatataagcacccacgcatgcttatactttagtagtctttttgtttctatcacggtcttgtttattctaaaagttgatcattggagagaaggtgaccttgacatgaaagtcggctcttgcttcaaagtctaaactgggacctccttgctgccttgaagggtaaatttatgatctctctgggataagaacatgatctttagactctattaacttttatccaacttctttctcatttaacatgaaaatgcttaggtttttgtttttaaccttgttttttagctttcattgtgcacttgctgatttcgttctcagtgtgacctcttaaatatccaaagggaaaggaaaattgctttagaaaacctctgtgcaaggaagttcagagaattggacttacctttgtaagaataatatgagctggatatagtttactgggacacaaaaatctgcatataccaagggagtgggacaatagacgtaatgatgtgaatggtaaaaataataaagaggactttgcctcatttattgattttttcaagtattttccatctgagttactgagtacagatctcttcctttcaatttacaaaaactaaaagaactaaagataggcaattatttgtggtacagatgcatttacaacaatataattctgttttaaaatcaagttgccttactcatttcaaagctaaggttgtgatggcatttctggaaattctccaatttatcttaaagttgacagtttttttttgtttgtttttttggtgggggtggtgggtgtggagaccgagtctcactctgttgaccaggctggagtgcagtggtgcaatcccagctcactgcaacctccacctccctgattcaagcgattgtcctgcctctgcctcctgaatagttggggttacaggtgcatgccaacacacccagctaattttgtatatttagcagagatgggatttcaccatgttagccaggctgatctcgaactcctggcctctggtgatccacccaccttggcctccgaaagtgctgggaatacagacatgagccactgcgcagccaagctgacgtttcttacagctattgcctcaaataagtacacgatggaggatgtccttatggcttaagtctgcctcatagacgattgttcagtgaaacacttaaattactccctaagtctcaactctaattccttaggtcataactaaaaaatttacttttggctaaggagtgcaagaaacagacaagcaaccaaaacaaaacctatacatactccccctccaaacacacaccaagattctctttaatattcattatgataattgtaaccatataaggagttctttttgcgtgtctgacagtatgctatacattgtcactaaacccccaaagaaaacttagaggtattattactaagttacagataaaatttttttaaaaagatttaagttgttctaacgtcacgttggtgaagattttaacccatctttcagaatataccatggacatagttgtcaggcaagcaagttagtgtagagatgcctttcattgtttaatggtaggtgctcttttagatgtctggtaggaacccaatagttatcttgtttattaataataacaggatcaagaggggaagtcattttctttggttctcttatttccaagcaacatttctgcattagtaatgaactccttaaacaaacactgaggattcttattagctttctttttctatggcaaacattattaactgatcacggcatctttacactggaagggctgggcagcagaagcttccacagaaggctctctggccagacaccaccaatcaattattgaaggtatcaaaattaaaaccaatgtgccatttctgcctttttctatcctatgactctcttacactgaggattagaaagacaattttgaatttttcacttaagtcttaagagacatgttgatttgcaagaggtatttatgaggtgttatgcagagtaagctagttaactctgatatcctctctcatggagactaagtaagttggctttccctgttaaggaaaatagtgttaacatctgcatttcacagtgagttaagaattttcgggaatggggcattacatttacggcctaggttctgaaattgtacatgaacaatttgagctcaaagattacaatgttgaaaatcagtgattttctaacagctccttaatgtatagcagcagcaacagccatcacaataataatataacttttccaggttcctactatgaagctaagctctatacagacaaagcttattttattgtactttgtgttattgtgctttgcagacaatgcattttttttttccaaatgaaaaatttttggcatcatttttgcagcagtatatgcctaattcatgtgtttgggtcacattttgggaaatctcagaatatttcaaattaattcattattattgtatctgttattgtgatctgtgatcagtgatctttgatgttactctcataattcttttggagtgccatgaaccatgtcagtataaaacagcaaagttaatcaataaatgttgtgtgtgttctggctgctccaccgactagctgttgccccatctatctccttttccgcaggcctccatactccctgatacacagcaactttgaaattatggcaattaataatcctatagtcacctctaagtactcaagttaaaggaagagtcacacatctctcaatataaatcaaaagcaagaaaagattaagcttaatgaggaaggcatgtcaatagccaagacaggccaaaagctaggcctcttggttcagttatccaagttgtgaatgcaaaggaaaacttcttgaaagaaattaaaagtgctactccagtgaatgcacaaatgataaagcaaaacagccttattgctgatatgaagaaagttttaatggtctgtatagatcagagcagccacaacattcccttgagccaaagcctaattccagagcaaggccgtaactcccttcagttctataaaggctgagagagatgaggaaattgcaaaggaaaactttgaagttagcagagtttggttcatgaggtttaaggaaagacactgtctccataacatcaaagtgcaagctgaagcagcaagtgctgttatagaaatcacagcaaaccggttatccagaagatgtatctgagatcattgctgaagttggccacactagacaacaaattttcagtgtagccaaaacagccttctattggaagaagatggcgtctaggaattttagagccagagagaagctgatgcctctcttcaaagcttcaaaggacaggctgactcttttgttagaggctgatggagctgacagctttaaaatgaagccagtgctcatgtatctttctgaaaaccctaaggaccttaagagttaggctgactgtgctctacaaatggaacaacaaaccctggatgatagtacctctgcttgcagcacagtttactcaatatttttaagcccacgattgaaacctactgcttaaagaaacaacattttctgtcaaaatatacctgctcattaacaatgcacctggttacccaagagctctgatggagaggtgcaaggagaataatgttttcaggcctgccagcacaacattcattgtacagcccttgagttaaggataattttgtatttcaaatcttattttttcaaaagttgattccaaccctcatgaatgactttgagtggctcgagactttagtgaaggaattagctgcagaggtggtggaaataaaaagataactaaaattagaagtggagtctccagaagttcctgaattgctgtactctcatgataaaacctaagtggataaggatttacttcttatggatgagcaaagatggaatttactcccagtaaatacgatgtgaacattgttgaaatgacagcaaaggatttagaatattatataaagttggttgataaagcagtggtagattgtattagtcagtctagagggacagaactaataggagatatatatgtatatataaaagggagtttattaggtagcattaactcacacgatcacaaggtcccatcataggccatctgcaagctgaggagcaaggaagccagtccaagtcccaaagctgaagaacttggagtccgattttcaagggaaggaagcatccaacacaggagaaagatgtaggctgggaggctaagccaatctagcctttttatgtttttctgcctgctttatgttctggcagcactggcagctgattagatggtgccccccccagattaagggtgggtctacctttcccagcccactgactcaactgttaatctcctttgacaacaccctcacagacatatccaggatcaatagcttgcatccttcaatcaaattaagtcgacactcaatattaaccatcccatggaatttgaaagggtagactctaatcttgaaagaagttcaactgtgggaaaaatgctatcaaacagcatcacatgccacagataaatactttgcaaaggaaaagtcaatcaatgtggcaaaatccatcgtcttaatttttgaaattttcatagccaccccaacattcagcaaccaacaccctgatcagtcagcagctagtaatagcaaggcaagttcctccaccagcaaaacatttagactcactaaaggctcagatgattgttagcattttttggcaataaagtgttttctaattaggatatgtccactttttttagatgtaatgctgttgcacactagtagaccacagtataatataaacataacttttttttattatactttaagttctgggatacatgtgcagaacgtgcaggtttgttgcataggtatacacatgccatggtggtttgccacacccatcaacccatcatatacattaggtatttctcctaatgctatccctctcctagccccccaccctccgacaggccccagtatgtgatgttcccctccttgtgtccatgcgttctcattgttcaactcccactaatgagtgagaacatgcagtgtttgattttctgttcccgtgttagtttgctgagaatcatggtttccagcttcatctgtgtccctgcaaaggacatgaactcatccttttttatggttgcatagtattccatggtgaatatgtgccacagtttctttatccagtctatcattgatggacattagagttggttccaagtctttgctgttgtgaatagagctgcaataaacatacgtgtgcatgtgtctttatagtaggatgatttataatcctttggatatacacccagtaatgggattgctgagtcaaatgatatttctggttgtagatccttgaggaatcaccacagtgtcttccacagttgttgaactaatttgcactcccaccaacagtgtaaaagtgttcctgtttctccacatcctctccagcatctgttatttcctgactttttaatgatcaccattctaactggtatgagatggtatctcattgtggttttgatttgcatttctctaacgaccagtgatgatgagctttttttcatatgtttgttgaccgcataaatgtcttcttttgagaagtatctgttcatatcctttgaccactttttgatggggttgtttgtttttttcttgtaaatttgtttaagttctttgtagattctggatattagcctttagtctgatgattctggatattagctctttgtctgatggagagattgcaaaaattttttccaattctgtaggttatctgttcactctgctcatagtttcttttgctgtgcagaagctctttagcgtcagcatgacttttaaacgcactaagaaaccaaaaatgtatgtgacttgcatcatcacgatatttgctttattggggtgatatggagtcgaacccacaatgtcttcaaagtatgcccatactaagtacccactccttatacactcaattttcacaacaatcttgtaagataattttattctttataagtcaaaacaaaatatttacagttcaggcttcagtaacttgcttatcagcaacacagctacacttctcaactgaataccaaggctgccttttcctctaaagttgtaatgtgacatagtactaaatgataccagagacttttcatggcaaacctataaaaaaagtagtgttggtcgggcgcagtggctcacgcctgtaatcccagcactttgggagtccaaggcaggcagatcacgaggtcaggagttcgagaccagtctgaccaacatggtaaaaccccgccactactaaaaatacaaaaattagctgggcgtggtggcaggcacctgtaattccagctactcaggaggctgagacaggagaattgcttgaacccgggaggcggaggttccagtgagctgagatcgtgctactgcattccagcctgggcgacagagcgagactctatctcaaaataaataaataaataaataagtagtgtttctaatatctctcaggctgtctttaaaactgcatgtttaaacagtttgctagactaatatgttcagtatccttggtagttgtaagtttcttgtatcttctttctttactctttctctgcaaaagcataatccatctcattgctgatattctcagattctaatctggtacaggttaacaatataaagcagtatgcacttattcacaaaataatatatatttgtagattttgtgattcacaataaatcagtaatagcatattgctctctctctcccctactggccttggtgatagttgttctgggaattctataaaccatggcatcatcatgagagagacacacaggctttctttctgatgttaatcaaaccatttctatttcttcatagcttttcattagatggattttggctttatgtaatacagaaacacatcttacttttaaattgaactgtatgattttaatttattcttcatctttgctaattgttttactttggtcaaatctgaaaatccttctatacctcagaaatgtatctggaaaaatggggataaacataaatcacagggttatcataaagattttaatatactagtgaggaattcctttgaaattgagtatgcattgactgctattgttattactagaacgacttggaagtggacatgaatcatttttaaatagttgtttggtggtacagtttttttaaaaaaaatttctataggtttttgggggcaggtagtatttggttgcatgagtaagttctttagtggtgatttgtgagattttggtgcacccatgacccaagcagtatacactgtacccaatttgtagcgttttatccctcatgctcttcccaccctttccccctgagtcctcaaagtccattgtatcattcttatgtctttgcatcctcatagttgagttctcgcttatgagtgagaacatacaatgtttggtttctcatccctgaattacttcacttggagtgataatctccaatcccatccaggttgctgtgaatgccattaattcacatttttttttcttttatggctgagtagtatcccatcatgtatatatcccacagtttttttatccactcatcgattgatgggcatttgggctcgttccatatttctgcaattgcaaattgtgctgctataagcatgcgtgtgcaagtatcttttttgtataatggcttcttttcctctgggtagatacccaacagtgtgattgctggatcaaatggtaattctacttttagttctttaagggctctccacactgttttccatagtggttgtgctagtttacattactaccagcagtgtagaggtgttcccatttcaccacatccatgccaacatctatttttttttttttttttggttatggccattattgccagagtaaggtggtattgcatttttggttttgattggcgtttccctggtcattagtgagattgagcattttttcacatttgaaaacatagcttagctcccacttataactgggggccatttctatattttcttttaatttttaaatagtttaaaaacataagcaaagctatatagtctcatattttaacaactagcttgaaagtatttaatggaaaaatttatattagtattgcttatgtaaacctttattggtagttggtgatacttctatcactcatgttaaattctcttctcaaataaattatagtgttttataacacacacatacacacacgtgtgcacctaacatttgttgtgatttgctaagtactaggcatataatttgcctcccaatttattacaagtaaggtttatcaaatattttaccactgcataacatggaatatcaccttgccagcctccaatagtatttccttgacaccagctgcctgactgctaaggcgttgacaactatttttgttttaattgtagcaggatcccactcttggtacttgtttaggtattagggtgatttcgatgggcccattaaccctactgactgagcatctcagtggctcaacacagaaaagatgcatttcttgcccatgctatatgtctgaatgactgttgattggctgcaagtcaacagttctaaaataaaactatgcttagctttaaaaaaataaaataagggtcagtaaaatatctagttatttttctttatttttattttctcacattttcatttaattttacattattttataaatataactgtacaaactgtaaagccagttatttgctaaagagttttttgataaaacaaaatgattgagtagaaaatctcaccatgatctttgacttacttaatggtagttacagaaaacaatttatataaattaaaaggccatacatagtccaagcaaccaacaagtatttgactcatacaaatctgtatcatgatgtccattagctcaagatgttgacttttcttctttttcttcttgctggtttttttttaaactattttttttttcatctagccaccagagaatgcttatgggaagttaacataaatatcaaacagtgttttcaaatattgtttatgcttgactgaatagggatttgcacaaagagtggttaaatatatggactaaaatagatgctccccattataaaataatatttggtagattacttataaaatttttcttgttattttgaaacccaaagttgtttatatatatagtcctactttttagatttaagccttttttatgtgtttgctattaactgacttagaaaaagtaataccttaaaataagaaaataaatgcttaggacaataggtagattgaaaattcatttgaaattaaaaaaaatctgtgacatttatttttgtgcatattagttccagaactgaaaataaagccctggcagtctcagtgtctatatatatatatgtgtgtgtatatatatatatatatatatatagagagagagagagagagagagagagagagagagagagagagacatatatatgaatgatatgaatgtgtactatgatacattggcctttttgaattacttttacaattgctatagttaagccataatcatagcaaaatatttcaccaagatgaaaggaatataaaaatgtttctggcattataaaaattgcagtgaagaaattggaacttaaagccaaaacaaatagcttacataattaaaacagagctttgtctgtggtaaattttttggcctggaaatgtgaaatatttcttaattcttgaaagtaatagttgtgaacacttcataaaattatagtgagagagagaatgtgctgtaattagcagctgaagagataaatagaaaatcttgcttagtcgtgtaccttacattttcatcctgacaatgctgaatacattttaatgagaataaaataaattaaaattaaagcatcagcatagattctatatatactgtttttccaatccacattccaagagtacctctgtgtttaccattgctatatatatatgtgtgtgtgtgtgtatatacatgtgtatatatatatgtatgcacatatatatatacatatatatataatttcattagtttgggggaacaggtgttttctgttacatagataagttctttggttctaatttctgagattttggtgtatctgtcacccaagaagtgttcagtgtacccaatgtatagccttttatccctcagctccctcagccccttccccccgagtctccaaagtccatcgtatcattcttatacctttatgttctcatagcttagctcccactaataactgaggacatgtgatatttgattttccatccctgagttacttcacttaaaataatgatctccaactccatttgggttgctataaacgccattattttgttcgtttttatggctgagtggtattctatggtgtatatattccccatcttctttatctattcattggtgaatgggcatttaggctggttcgtatttctgcaattgcaaaaacaaataacctcatcaaaacatgggcaaaggacatgaatagacaattctcaaaagaagataaacaaatggccaacaaacatatgaaaaaaaatgctcaacatcactaattatcagagaaatgcgaattaaaactaatgagataccaccttactcttgcaaaaatggccacaattaaaaaaatcaaaaaataatagatattggcatggatgtggtgaaaagggaacacttttacactgctagtcaaaatgtaaactagtatagccactgtggaaaacagtatggagcttccctaaaaaaccagaagtagaattaccgtttgatccagtaatcccaatattgggtatctacccagaagaaaagaagtcattataagaaaaaaagacccttgcacatgcatgtttataccattgcttttagattttactttgcagacttgtaagaattctgtgatacaatgggaatatgttacttttgttgctgagttttacatgatagatttctgtcatataagtcagcaataaaattaatgattaatgattcttatgacctccttatatatatcttaatgagaccaacattaaagtttggcattaattaaattctgggccaaaaaatatattatttcagacgcagcttgtacatttttttaaattgacttttgagctgatgttaggtttgattagaaaaacatattcaatgagctccaaaagttgtgcttatatgtgatgtcagaaatatccggatactgaatacagaaattgaaatgaaagatggaaacctgaagaagactacttttgaaatagagtgatctaatttttatatttactaccttcaaagcccacctctcactgtatacttttttggggtaaaaaaaaaatgtgcacttcacattcccagttatctacgaactgactagattcatttaaattcattacatagttatcaaaccttcactacgttacaggactgtgctacatactggctagacgacaataatgaagctcattgaaaatatcattagggacacacataatttgctgagctttccaccaatggaattacctaggtgctctggtacatgaagacaaactttattctgcctggggaaagcactggggttttccagaagaggtcatctttggttaagccttaaaagaattggtggattttttcaagtagaggtctttctgagaacactgtaaactgaatgatcagtgtgaacaaatgtatgggccgtaagtggcctcacagagacaggagaaatgtccactagttgagtgtttattgtagcatctgggcgaagtgtgaagagaaacagatgagcagtgtgtcaagtagggaggagaggcgacagaacggagggaaactggaattgtgaggattcagtgtatgggacacacacagatgttgttggggcggtagacaggacttgggaactagatttgaactcttattttactatatgtatacttattttacccattattatacaatgctacatattctgatagtaaaataagtataaccacatctaccatgttcacatcttgaagagggttgaagaaaatcaaatgacgtggcttcgaagtccttcctccgaaccagataggttctgctcagtgagtgagggtgtatttgcctagacatgcaaatgaatgaatgagagaagtgcacgagaaaacctactatcaccaaagacctacgtcagttttcccaaacagctttattagtaatacagctaacatttaaattcaaaaatgataaaatgaggagaaatgcttacatttgtcatttgtattagggatgagtgactacaattgggaaacagagaggaagacatttttgtatttgaattgttgatagatggtaatgctaagaacaggataaagaatggaggagaaaaatgaggagaagctggggagagacttcaggtaggatctactgtttttttacagttggtgaggtgcctgcatgtcctcatcattgagctacaattttgttttgatgtcaaccaaggtgtaaaaactagatcatccgtatacaggtggcagttacacttgtgggagggaatgtgatgcccaggaatttgtgtaataattcatgtgttagacagttgaatcatgaatagtgaatgcagaaagcaaacatatgatgtaaattcttgaatgatatttatctcggagaatcaggagaccctgaaatgagcaaaaagaggatgactgccccatgaaaggagccctagagggaagagcgaaaagagatagaagaatgtattagggtgtgaacatcacacaactgatggataggataagacctgagaaagggatcattactcttgccccaagagagtcagtggtgtcttgcattgagtacttttcagtggagtggctggagatgaaatacaattgcaggaaattaaagaatgcatggaggtaaaaacaaagaaacagaaatgcagtctacactttcaagaaggttgatgatgatggaaagaaatgtgtttgagaataaaacaccccgtgaaagattagcatgcaaagacaacacaacaaaccaatatactgttttgtttttccctttggtcctattccaactagctaatggtggctgtatagccttcttatatgactcaccatttagtttaggttttctgtctccagggagagcataacatggtaaacccttggaatatcatgtctcctttgctagttttcttctttccagttcaggggattgcagtgatattttccatcattgactgcagcaaagatcccaaaggtggaaatatgcctccctcaaaggtactgatgtcatctccattaggaggaatttctgtataatctcactaaagacaccatgaagatttgtcctgtgttttcagtgtctgatggatgctgctgtaaggcagctcttagtttttatttgcacttttatgctttaatgcaattctccctctctctaggactcaagtatgagtcccacaggagaagggctggcagaggcattaagtgctagaccatgagctgtattgcatcattctttcattcagacctggctcgtggttttaaactatagttgtatactctggcctctttttctttagaagatatttctttcttttttcttttttttaaggggcctctctgactatgcttacagacttctttttctttgtgagtcaatcctgcttgcccatcacaagtactcagattaggctaccaattggagtaacctgctgctacgttagttattacagagggaattgtgttatacagagggaataagttatacagaggtaatgatgaagtaggtaaagttcaaattgctgttctcttgcttttcattgaataagggagggagatggggtaaagggtagcaaactgataatggaaaggaagagtggtgctactttcattaatatctaaaaagcaatagccgacataactgtcttcatgctaaaatcaaaagtgtaagcaatatgataattcttaatactgccatgtgcagatgtaccaatcatgcttgtgttaatgcaccatgtaaccgagaagatgaagaaatcaaagacatgtgattacatccaaagaccaggagaaaatcacgatagtattgaggatactttcaaagtaagtggctaaggaaaattttgctacatctttcatgaatgtcacagaaaaagagacagtttgaaaatggaaatttttccaaatcttattgaagttttgctagtatattttactgagaattgagcaatgatttttgagatcttcattatgctgaagattaaaaataccaagttgttgtttctaaactcatttttttcagagaatagatagcttttcagcatttaatatgtacaataaattgcactgtggcgatacacagatgaatctgacacagtgtctattctatttaattaatgtcctgatataaaacgcactttagaaaacattaagcattataaggggtaaattattgaaggtgttcaaacagattatgttcatatatagcgattaggaaaagccttgtaaaaattttggcattagttggacctttataatagatagcacttagaatggcaagagaaaatatggtgccttccaaatagagggaaccacataaatcacgtggtagaagacacaagcaatgaacatagaatgcatggcctctttttattgggtcgagtgattttatgaaagaagttaagagaaatgaggttgaaaatgcagtttgaggcaagtcatttcataccataataaggagtgtgggttttatctgaaataatttcattgggtaactttaaaacaacttgttaaatgatctgatcggaaattctacatagaagctactgcagatagcaagccttttgagttctactttttttcccctttcaacaacttctacgtaagaagaattaaagtccacagactatcagaattaagggaactttgattttcttcctcaaaatgatgcctactgttaagtatgaaaggttaaccttactccaggaaaggaagagtaaatctatggggtcaggaaggctgttgtggtgaatggataacttaatgaaatgatcaaatagtcctgaatgatgttaattagggcaattttgtattactataattgctttgtatttattgaattattgcaatgggtgagttactagacagaaagaaatctatgcagtacgctgaccaaacactgaaaggatgacagaattggaatgctcttggctgttcaattcactgcttaagcagtctccaaatacattaggctattttttttctttttctctttttcttcttgctcattatctgctcattgtccttggatgggacagttccttatttgagagtatatcacatgttcagatctttttcatataaactttcctggcagacactgattctacaagtgttgtacattgtttaatgattttgtaaaacagatatttactgagagactgcagtaagacagactcattacccaagatcagtgaacccactgcatgcaatagatgaggaagcttctctcccataattccgaactgaaatacaaatgctgcctttagtcgcagaagttaaaaccttaaaagtttgtgttgaatagggaatgtcattgggggacatatcgaaccatgtgttaagatgtgtgaatggaagggtctggagaaaagagagaagattggaagagaaatgtatgggtggtacatgtagggaatagggactcaaagggaatgtctgagcaatgggagacactgtgaggccatgggatgtggcaatggcagcctcagctcatagtacggttacattatttattctttttagttttccagaaaaaaaataatattgccaagtatgccaacctaaataacaactcatgtttcaacactgtattttctaggttgttactggcaacttagaaagcctttactttggaaagagtgcttgagtggtattgaggttcccacattggcttagcaaagtcttctttgataacttacttctagaattatattaatgaacagtagtaacttgctatttcaaacatgatctttatggggaaatgtgtactgaactccagtaaaatgacaacagcatatatgtccacaccatgacagtcttttatgccactggaaaatgttcagaagtggaggcttcctgccagcagtagtggacagaagaatgaaagtaagagtcagattttttggaaaagcatttcatagctttcgtccccggtggctttggaggaatatgccacttctgttactgtgggaagtgcagtcagaaataatagtaacagtggtagctgccagggataggtctgtggactttgggaactgaagtacttgaatttgctatctttatcttgattggaatctatgactattttaaacactttctccaatttacaacggcttctctaagaaaagcttcacagctttctttcagaaaagctttgagaggtaggtttgattggcctagttttattaatgatggctttaaagcatattgagattgaggctgtcactgccaaacatagcacctctctttgtgaggccctatttctccaacatacacatttctcactctctgccactttttcagctgtccagtttctctgctgatctgtaaattcagtcatggaggaagaataagcttaatataatcttcttattagaaagcttttactgcgacaaaaaatccccaggatcttagctctaagtctcttcaacccctgtctataggacctacgtaaagggcaaaagtgtaaaataaataaaaggagataaaatgaggagaggggcaaaaacgaaagaattacttattaggaaaagtaagagaatgtgaaaaagaattatttgcaatgtcaaggtttacatacttctccaggtcaagtttatttttctccaacattattaatgatttattgaatctgaaccccaagcataattctgttctaggcagtgaggagtcataaatatgatagaaaatgttcttaccttcagagtggttacaatgtgatagaaaagtgtatatttataaaatattctaagttatttcaaaatagaattgagaatgtgacaaaagcataggctgtagaaaaaatggttttaggtagattttctctgggcagccccaccttccagtatcagtaaaaaacctgtgttgaaaattgctaccagacaatctctcttgttgagcatgtctaaaaaagtttcatgcctatcagttttgtattctatcacatatcagtatggtgcccttaagcagattccaagaggacctcctcaatcggaacatatcgcctcataaattataggattaatttgttttaaagatgccaactttctctcttattcaggaatgctttttttctgaaaatatacttagaatcttagtagatactctcgtgaatttcatgactaattctaatttgttcaataaactgttgattaaattacataaaatttgggcacactggataataagtacagagaactcatccctgtcccttcaaccttgctgtgggagccactgttcttaattttctaaataattccagtgagtacttttacttaaattatttgaataattccacctgtgcaaacctgactgcaatgggctgttaacctagaaaccctgagtattagattatatctgaaataattgccaagcttattgtttagtttaaccctagtttaactcagatataccaatgcctcattatgtttgttaactctattctgattcttcacatatgattaattatgatttattgagaacatcgttttccctctgtgtttactacagtccacagagtctataggagcggaaatctaatgggtttggtgttcactggagttgttcctttgaaataattaaggctttattttaaacttagcaatagggtaaggactgccagatatttctttatgtacttgaataaaatttgcttaaattcttcaaatctctggtctcaaactaattgatttctctgatgcagtgcttccttctcccaattgtgtgcctttaaatgaaaaatctctcttctaaccctctagctataaggagtttgccaaaggcaaagttgttaaccaagatttttattttgacccatagttccagctttcttttcgttttgacagttaatatgaatatacagaatctcagtgtattaggctattcttgtgttgctataaagcaatatctgagactgggtaatttatgaagaaaagaggtttaactggctctgtaaggtgtacgggaagcatggtgccaacatctggttggcttctggggaggtctcagggagcttacaatcatggaagaaggtgaagcaggagcaggcatatcacatggtgagaacaggagcaggagagggagtgggggaggtgccacacactttaaacaaccagatgttgtgagaggacagcaccaaaccatgagggagccttccctatgacccagattccactagtctctgccttcaacactggggattacatctgcacatgagatttggagggaacatatatccaaactatatcattccaccccgaacctacaatctcatttccttctcacattacaaaatacaaaaatcttgtcccaatagtcccccaatgtcttatttcatcccagcattaactcaaaagtcctaagtccaaagttccatctgagacaaggtgagtcccttacacctatgagcctgcaaattcaaagcaatttatttacttccaagatgaaaggtgggtgcaggcattggataaacatttctgctccaaaaaagagaaactggctaaaagaaaggggccctaggtcccatgcgagtttgaaacctggcaggacagtcattaaacctcaaaacttcaaaataattttgttttactacatgtcccacatccaaggcacactgctgcaaggggttggctcccaagggcttggacagctccacctctgtggccactgctctatcaggctgttgggtgtttttccaagtgcaggatgcaaactgctggtggatctaccattctgaggtctctagggcagtgtcctccttcccccagcttcactaggcaatgccacagtgggaactccttgtgggccctccaaccccatatttcccttctgcacttccctggtagagcttctctttaagggctctgcccctgaagcaggcttctgcctgggcggccaggcttttctatacaccctctgaaatataagtggaagctcccaagccttcttaactcttgtactctgcatgcctgcacgcttaacaccaggtgaaggccactgtgttggtccattctcatgcttctaataaagacatacctgagactgggtaatttataaggaaagaggtttaattgactcacagtacagaattgctggggtggccttgagaaacctacaatcatggtggaaggggaggcaaacatgttcttcacatggaggcaacaaagagagtgccaaagaaaagaggggaaaaccccttataaaactgtcagatctcatgaaaactcactcattatgatgaaaacaggatgaggggagtgaccccccatgattcaattttctccacctgctctctcccatgacacatgaggattatgggaactataattcaagatgagatttgggtggggatatagccaaaccatattattccacccctggaccctcccaaatctcatgtgcttgcaatttaaaatgcagtaacgcccttccaacagtcccgcaaagtcttaactcattccaacattaacccggaaagccaagtccaatgtctcatctgagaaaaggcaagtcccttcttcttatgagcctgtaaaatcaaaagcaagttagttacttcacagatacaatgggagtgcagacattgggtaaatacacccattccagatgggggaaattggccaaaacagaggggctacaggccccacgcaagtctgaaattcaatagggtagtcattaaaccttaaagttccaaaattatctcctttgactccatgtctcagatccaggtcaccctgatgcaagaggtgggctcccacagcatttggccgctccatccctgtggcttttcggggtacaggtgctcttccggctgctttcatgggctggcgttgtctgtggctttacaggtgcccagttcaagctgtcagtggatctgccattctgggatctggaggacagtcgtcctcttctcacagctccactagatagtgaagcaatggggactgtgtgtgggggctccagtcccacatttgccttccacactgccgtaggagaggttctccatgaaggctctgtctgtgcagcatacctctgcctggacaccagggcatttctgtaaatcttctgaaatctaggcggaggttcccaaatctcaacttttgacttctgtgcacctgcaggctcaacaccatgtggaagctctcaaggcttggagcttgcagcctctgtacccgtggcctgagctgtaccttggtcccttttagccgtggctggagtggctaggagacagagcgccgagaccctatgctgcacacagtaggggagccttggcccaggcccacaaaaccatttttccttcctgtgcctcttggcctgtgataggaggggctgccacagaggtctctgacatgccctaaggagactttccccattttcttggtaattaacactctgctccttgttacttatgcaaatttctgtaaccagctttaatttctccccagaaaatggggttttcttttctatcatattgtcgggctgcaaattttccaaacttttacgctctgcttcctctttaattatttgacgcttagaattgtcttctaccagatatcctagatcatctctctcaggttaaaatttccacagatatttagggcaggggcaaaatgctgccagtctctttgcttaagtataacaagtgtcacctttgcttccgtttccaacaagttcttagactactgtggcctgggcgtcattgtccatatcactatcagattttggtcaaaaccattcaacaagtctctagaaagttccaaaccttcccacatcttcctgtcttctgagccctccaagtctctaggaagttccaaagtttcccacattttcctgtcttcttctgtgccctccaaaccgttttgacctttgcctgttacccagttcaaaagccgcttccacgttttcgggtctctttacggcagcacccaactttctgtggtaccaatttactatagtagtttgttctcatgctgctaataaagacatacatgagaccgggtaatttataaaggaaagaagtttaattgactcacagttcagcatggctggggaggcctcaggaaacttacaatcatgatggaaggggaagcaaacacgtctttcttcatatagcggcagcaaggagaagtgccaagcaaaagggggaaaagccatttataaaatcatcagatctcgtgagaattcactcactatcaaaagaacagcatggaggtaaccactcccatgattcaattacctccctctgggtcctttcacagcatgtggggattatggggactacaattcaagatgagatttgagtggagagagccccaaaccttgtcagccaccgaggcttatggcatgccttctctgaagcagcagactgagcagtacctgggaccctctgagcctgtggctggagttggagcagtcaggattcagggagtagtgttccgaggtagtgtatggctctgatactctgggcctggcccatgaaaacattttttctcctaggccaaagggtctttgatgggagtggatacctggaagactgctgaaatgcctttgaggccttttccccattgtcttgtctatcagcacctggctatttttgagtcatgcaaatgtattaagtggttgcttcacagcccacttggattcttcccctgaaaattttctaacacctggccaagctgcagattttttaaacttttacactcttcttccttcttaaacagatgttccaactttaacatcaattatttgctcctgcatctgaatgaaggctgcttgttagaagcagccaggccacatcttgtacacgtggctggttagaaatttcttcccacagatactctaaattatgactctgaagttccaccttccacaaatccttagggcataaacagaatgcagccaagttattcactaaggcacaacatgtatgacctttgctccagttcccagtaggtgccttacttccatctgagaccttgtaagcgtgaaatttcactgtccatgtcatatcagcattttggtctcaaccatttaaccagtctctaagaagttctaaacgtttccttatcttcctgttttcttctgagcccttcaaactcttccaaccctttcctgttacccagttccaaaggttcttccacattttcaggtaatttttagcaataccccactcctcagtacaaattttctgtattaggacattctcgtgttgctgtaaagaaatacctcagatggggcaatttataaagaagagaggtgtaattgactcacagttctgcaggttgtataggaggcatggtgctggtatctacttggcttctgaagcctcagggagctcacaatcatggcagaaggcaagggggaagcaggcatgtcacatggtgaaaacaggagcaaaagagggagtgagggaggtgccacacattttaaacaactagattttgtgagaggacagcaccaagctgtgaaagattcttccttatgtcccagaaaccacccaccaggccccatcttcaacactggggatgatatctgagcatgatatttggagaggccatatatccaaactgtgtcactcagtatggcatttcatctggataggatgtacaactaagtagaagcccccttagtttcagatgttgagtatttttttcctaagttacataacatttggtctacattagtccattcatataacataggtatatgccttgatgatataacctattttgtcttctcgtttaaaatcatttaatagaatggatttcaagtcagtaatgtcaacagaattgaattcaaagttataaagagtcctagaaggggtttttttgttaagagaaggattcaaactgtggaaaagagataggatatatgtagaattccacttgcaattaaaatatatgtaccgttattttctcttttcctctactcttgtgattacttctattccttaaatggaaacagctgtcattaaaacgtgaaaatatttctgtttaaaagcaaatatttattgatgctaaaagcatcaaggaaacaaacacactttcaagttaaatttgttattgtcatggtacactgaaatagattttgttatactttatatgcctgaaattagtatgctatgcaaaaggattagagtgaaagatttaagcaggtcagcagtgaagatgctgccagtagctggtgttaaattgaacgtttaatgtgtgtcagctatatgaatttttctctcttaattttcatggtaacttgctgaaataggtaccattcctatttaatagatgataaagttattcagagagtttaaatagctgattgaaacgtaggataacaaagacaataatccagaaacaaaattgttctagcttacacactgtagtatccaagttggcaaaaaaaaaaaaaaatctttaaaatgttgttaaataaattataattaaattgaaaatcaccctaaattgaatatagaataatttgtaataataaataaacatgcattcaacatgttaaatgagaaaaagcagattgcgcacttcaggtataatgattctattttatttcatgtgcttacacacattgggaggctgagatgggaggatcacttgaggccaggagcttgagaccagcctggataacatagtgagatgagggcatctctactacttagggcacactggcatgctcctgtagtcccagatactgtggaagctgaagtgggaggatcacttgagcctgaggctgcactgagctgtgatagcaccactgcactccagcctgggcaacagagtgaggccctctctcaaaaagtaaataaaaaataaataattgtgcttacatatttatcttaccaatgaagattgagttcagctgcctgtaacagaacaccaaaaattgcaatggcttgagcaaagttaagtcatttctcttttatatagaagaatacagaggtagtcatccaggacagatagagttgtggtcatctatttcttgcaccttgctaacatttgtcttccaacctgaggatcattctgtgatctacaattactgctggaattccaatcatcctgcctacattcctggtgcccaaagggaggaaggaatagcaaaaggccgggtgggtggggtggctcacacctgtaatcccagcactttgggaggccaaggtgggcggatcacctgagattgggagttcgagaccaccctgaccaacatggagaaaccccatctctactaaaaatgcaaaaaaattagatgggcctggaggcacatgcccgtaatcccagctacttgggaggctgaggcatgagaatcacttgaacccgggaggcggaggttgcagtgagccgagatcgcaccattgcactccagcatgggcaacaagagagaaacttcatctcaaaaaaaaaaaaaagaaagaaagaatagcaaaagaaacacacttcatttatttgtacccatattagtaatagtaccttatccagaatgaccctagaaaaccatttacttattgttcattggccaagaacataattacatggccacacttagttgcagggaagtataggaaatatttatagtctgtacctagacatattgctgccctatgtacctagacatattgctgccctaagtactattcttggatgaccatttagcggcctctgtcatgacatatttgtattgaatgaatgatgatattaaaaatacacatatgcataaacatattcacacaaactatatatgatatatgctatatagcataattttattatctatgtgcatttttctttacttacaaatgtttaatttggtcatacttgatttagtatatctaatagtcgttataggtcagtcggtcatatgtttctttttatttataatttaaaatatgttttaccttatataattacacttttaaaaatgatatgtttaaaaactaataaatttgaaaatttatacaattcattcacgcttttccataaaacaacacttctggcattaatgagtcactgctttccataaagtatacataacaattatatgtatttattacacattctatattatattatatatacattaattatgatatataattgtatcatgactatgtataacttcatggtattatgtatataacatcgtggtattattttcaagccttttgttaatatcagactgttttacatagcaattaggaagctagaaatgggttcaaatcattccgttggtaataatttgaacttacttttctttcatggcatgaaagtttttgtgtgctactttttactattcctaaaccaagaaacgtgaagatcatgtgaatgtatttgctgttcaattggaggtcagacgttcaactcaagaaaggcttggcgcaagataaatcactctgctgtgaaatgagtccataaacacaatgcacttgccagccctcaaacaaagtagatttacaagtttttaaaaatctcagtgagaagtactgttgtttccttgagtgtaagttactcttattcatgaatatgtttaaattttagaaaactggaccacaaaagtctatcctaactatagtagtctgtgattaaaatggcaaaagcaaagggtgtatgatttttaagctcattttagtgctattttctagtgttttaaatttttttggtttgttcttaaataggttttaattggaagtgttcttttgagaaatggaactaaaactttgagtggggcagtatacttttaaagtcagagtctatccttgggttcataagttcattcaatttggaaattaaaagtagaggaaactgacaagggagttggggcgtgctgtagaattactctcaaagctaaacatggagttaaaactgtgtcaaaaccataattagtatttgcccttgaattgtccttgttaatagaagtggaacagtggaaaatactgcatagaggcattgtctggaaactgcatttcatagccaataaattcaaaccaccttagtggaatataattatgaggaggagctatagtctctgtggctgaagaaaaaacaacaacaagaacaacaacaacaaaaaacgcagagcatgtcttgctctacattctaacttgcatcatggaatccgccggatctatgccattttggatttcattgccaccggttgaaagtggtagatttctttttcttaagtcggctagaagacctaattttagtaagcctaaagggcactgagcaatacaactactttggtggatcgtttccagtttgaggattcctagtgcacaatcagtgaatgttgtatggaacgcatggtgaagaaatacggtttagtgaatctggaaacttaaaaaaattggccttggcatcgtgaggaattcccatttggccttcagcatttttgtctatgttggcttttctgtcccaagactttctataatccaatttatcacttgctttttgggttaaagggaaataaaatttccacacttcttcaatacatgtgctggagaggacaaggggagggaatttattttgtgtgtgtgttgtaaaatcagaagcaattgttgaaaggtgatgaacagtttgaaaggtatgttgttctcttgtactacatccagtggttactatgaagtttttctcatcactcttttgtatcctttcttaaattctgctgtgtggcagagtatcttatttatctccatattaacatgccttttgcaaggtttagttatattattgcaactgttctcaaaagatacaagcttcctcctaaaacacgtcacaatcaggttttgctagacagctactaacagccttaaattaaacaggatctcaggatgtcttgtcagtttgggttttcagctgcagacagttgacaagggataaagaggacagaactaatgccacatgccatctccctccaaagagagaatccttgacccctgagtttaccattctcatttttgagattccattttcacttctaccacatacaaattgctttccttgtttttaacacagtgaagtaatttgaaaaaaaaatctgataatgtatctcatatctctatgtcttttaataggaagagggcacatattaattcaacgtattcatttgcaagaacacaaaatcctggacttttttttttaacttactgatcattatatatctgagaaatttggtgtaacaccaagtcttttgtcatcagtagctcccattttttaaagacttctatctctatattcaataaatgtcacaattatttgctatcattattttaatatgtttactattatttttattttaaaatatgttctcattttcatatacttactattttatttttagtttaaaaatattttttcagaaacctaaaatgtcagtgaatacaggtaaatatttattcattttgactacatagaaatctaaagcaaatattgattgtgatatgtacatctacatattaatataacatttttataaacgtattgtttctgtttcaaacatgagtcttggtcaataattgatataaataaaaattcaagttttccacaaaattttgcttatgtaaaattaaataaggtaacctttatattcagtcagttctggctcctggataaattgcatgcttagaaatttcactttaataaaataaaagttttctcctcatctgtaatgtattctcccttttactgtactggcatctacatattgactgttttcatgaattatttcttcccaagatccctacaaagaagtaaaactcattcataatagattgtatattaatccccaaattccatgtaattctacagaaggaaaaaaacataaaccaaaatcatggtacttgcagtggaagaagcataagcatcctacatttatacccttttccccataaatacatagtgtgactggcagcctgcacagtaatgattaaatgagacaataaaatcttagcaattcttaccctgagtctggaagtgattaccgtgtccaagagcaagtcatttcctttttctaggtgtagtttttttattctacaaaatactaggaagagattatctccaacagaagtcacatcttctgggtcaaattaggatcacaaacatgtgtttgtgtattaaaatgttttaaatttgaatcagctgacaatacttcaaaaattgggagatttgatattaatatcttgtaacacataatgggtaaaagactgcccctggcaaaagcctgcatctctggttctccagaagccccacccttcccccttgctaccagtcacttaaaccaagtctgtgttgtggcttaatgtctaattgcctttttatttaaaattctgactttggcccctggcctagaatgaccattaatggtatatttagccatgatatctatgattctttaaccaataactgcttaaggctatccttgccttgatgtttctcccagagcttgcctagtcaagcttcatcctcttagttaattatggtcctctatagaatatgtgctattctgtcttttaaaggcttttccagggatacatttgacatatttaaacatgatagctaggtaagctgtttcaaaggcattatcctccataaacattctactcttgtataaaaagtcatttcaaaatatactattttactagatttattcatgattaagtcaagagttgctccatcggattagtatttattttcaattgccttccttatatacatgttagatagcgttgcactctgaaactggatttgaaactttatttttttctttataaaatattagtgcaaaaatcacaaagggattcaaaacacacacacacacacacatactcattattcaatagattttgtatgtttgaattcaagaaatgatgagttataagttatatctgaaatgtccaggagagtgggtcttaattcagaaagaaaaaaatggaaggtagttaaaaatgatttccatagtaaatactcaatagaattattcactaagaagaaggaaattatgttgaaaacttaaacttttgaggcttttcaagagtgttaacaggtatctgtgacatattttttagtactttaatttggtggacatattcttataatctgagttacaaatcaatttattaaaacttcaattagtttttgtgaaaataatgctgtacaataaatgatgcaaaatgtcaattgactaaccaccgacaaaatttatccctcactgaaattcctgtatgttgttaatgtgtccctgctttgggctgtaggttgggttcaggtatctatgtgtcttttaatctggagcctatcctttgctggggaataatatttgtacaggatagggcaggatcgcataaacaagtcaaaccacacatgtgcatctacatcctggttggatacagcttattatattaactcacattcgattagttgaagcaagtcacaaggtcaagctcaaagtcagtgaagaggagcattatagaggcattgtggctaaaccacaataagccatttcaatgtggggaaggaaggaagaattgtgaacacataatactatctgtcacatgaaatatgcttggtaatttgcattattttggatatttcacataacaaattcaaaatatagcttgagaaagataatagacaaagatgtcacatattttggaatgatgtttaagaaagatgatgctgtttcagttctgtaagctcttaatatttatcaatatgtcatctttgttttaaaatgtaaagctttatctacatgatgattgtgaaaagtgggtaccaagttttgggctatgtaatagtacatgaaaggaaatagtcataagaaaatcatgaatttagaaaaacaccattgcattgatagattttattaggggtgtcaaatgtttcagcttataggttagagaaatataagcccctcttttcatactgctatgtggtatgacttgctgttattataaacttctgtacattgcacttgagtttgatgaagatccataaagatttagtcattgaaacataacagccattgtgccacataaccttgggttgaggtctcaattcagagccaacttcagacagcaccatgaataaaatttgatcttgccaatttcacattccccatttctcccattcaatatgtacacatcgatgttcccaatgtctttattttgtcctttggctttggattccatatatatatatatatatatatatgcacacatacatatatatatgattctcctttaatttcactcagtatcctgtcttacccattttgaacatctgtttaataaacagttattattaggcactctgaatttaaataatcaggagacatggttccctaggatggtggtattcaaatgattttacaaaaatcctggcagattataagaaatagattttaattgcagtccactaaatacatacatatacatgcatacatgaagcaaaaatttcacaaataataataaccttactacaggtatacattatgatttattttatttcattgggggtgagtgttggtagccactcactaaatgaatgtcagtccctagtgtttctgaattcagtgtataatagcactttaagattttaggtttaatggtggccagggataagggtcagggaaaggggcagctacacatatctccagtattattaaatgccaaataaatagtgcagataataagtgctgaagtgtttagaaaaaggggccaggcgcggtggctcacgcctgtagtcccagctactggggaggctgaggcaggagaattgcttgaacccgggaggttgagactgcagtgagctcagatcatgccactgcaatccagcctgagcgatggagcgagactctatttcaaaaaaaaaaaaaaaaaatttagaaaatgaagaagcttattttggctaaaatgtaatactagaagttatcaaagatgaagaagaagaggtaggacttgaatttcatattagtgtttcaaaatatattaacatgaggaggtaatttaattattatttaggaatggttatcagcaagacatattttagaagctctgtaatagtttcgagggattaagtataggagttcattttgggaattactgtgagataaacatgaaacgaaggattgattatgtattatatctgaacatgaattccaggccaattatctcaacatttatctttcatgcaatggagattttctttgagtttctgatatggaagctagaatgatgtaaaaaatatttaggaaggggaattcgatatgcaccatggtcacctacgtgctattgtattttttatgtttttcttagatttttcaataaaaattctaccatgtgttttctggggcttgttagcaatttagtaggagttatattgaatagtactttaactcaagtgaaggataactaggtacactcttgagacaggtgttcattggcatatgatgtattcatttcacacattataggttctagccttagaatttttcatgttttaaaagcattattccaagcatccaatgtatgttgcgtttatcccatatgattttgtccagaatggttactgtccacagaggttttatctttgtctgtggtattaagctttttgaggacaatgcaaatggcttcatattcgagaatgataataatttggtcaacttttatgtactgagaaattaattgaagatttcaaaagactaaatagcatgaaatatttataattgctgtatagtgaaaaataatgagagattttcctatccttatacggtattttgcagagggtataagcaaaagctcttgtgatttttattcattttgggggggagaattggataaattatgttatgtgtttaaggtactggtttttgttttattgtaagcaaacttatttactttttatagtgctagtcgttatcaatgccagaggactgctgaattgtcctgttcccacctccagtcctataggacttcaccatctaaaaacaccttagttcccatacagctttgctctagagtctagaaagatgctaatgattatatgctagaaggaatcaagtaatatttggaggaattgttcttgtgtcttctagattatcattttagaagcaaatcatgctttctgtgagatgtccataagtgcctctatcagagacggattataatgctgtggtgttatgggtctgattctgtggggagaatttagcttactaatttcgaacatatatgcaatatgtatcaaatagtaagtgctgcaaagtatgtccctgtgctttaaaagggaattactgaagaaatttctaatttcacaataaaaaatattttagagtagcagggacttgtttttaggaaggaaatctgccatatattagcaagcaccattacattttaaagtgatatttttcaggcatgtaaagagtcaagttcttgaaaataagaacacctttattatcatgtaactgcatttcagcactgcatcgctctctgtattcccctctcctctccttgcctacctctctcacctttatttcactctcttccttctaatcttgtcactttgcttttcctgcactttccttcctcgaggcatttgtttatgcagtttctgtagccccacatgcttattcttctcctataggtaaacacaattccaatttttcaaaatccatctcaaatcacagagccttcacgatggctcccaaagcttccatcagatttaatttgatgtccccatatttgccatagattgtgcttttaaaaattgtagttatccttctctgtcttatttaatggtaatttatgtgtgtccactcatttcataatgctctactgtaggttaaggcctatgtctggctcacaaacatcttactcattgacacagagatttgcatagagcagacaccaaatagatagttacactgaatattttatgaatcatattaaaatctataggtggcttttaaccatactttattgatgttgtttaattagaagtctctctcaaaaacttcatatgctttgatgctggggaggatgcctcactcattgttgtatccgtatttgtaactaacatttattgagttccagttatgtgacagactcctactagctctttgcactttatatggctcatctcattgagttcttagaataacccaccagaataggtgggcagtaatagctgcagtttataggggaaaaaaaattatgagtcagaggctaatttactttccaaggtttgaagaggcagtaagtgacaaaaccaagataaaaactcagaaagcttcattactttctgcaaaccttgaacaatctagtgaatgaacgaatgtgtcttcagagttatgacataaccagcaggagaaagaaaccatcatgcgacttcctaaaatacgatgcattatttctttcaacaaattatttaagtaagtgtactatgcttagtagttatgtgaatcattatcttggattttattaactgtagggctgtagactttggaaagaaagatcctaatactgtgttcaggaatcaatgagaaacaaagatattagtagaaaaatggagtggaagagaggcagtgggtgtatcgattatgtactttggtgattatgatttctatgctatggatatttaaaattttattttcctcttaatcttcaatttccatcttctggtaacttctttagatataagaccaagacactttctttaccgttatatctgctagatttttatccagtgtattttaagaagtcttttttatccagtgccttttaagaagctcagtccgggtgcagtggctcacgcctgtaatcccagcactttaggaggccgaggcggcggatcatgaggtcaggagttcaagaccagcttggccaacatagtgaatacctgtctctactaaaaatacaaaaattagctgggcgtggtggcacgcacctgtagtcccacctactcaggaggctgagacgggagaatcacttgaacccgggaggcagagtttgcagtgagcggagaccacgccattgcactccagcctaggtgacagagtgagactccgtctcaaagaaaaaaagaaaagaaacagaagctcaataagtgttatttgggataaagcattaactggtttaaagctcaagattttaaacaactcaggattgggcattaaagaataacagaagctaccatctattgaatttttattaagacatttcaggacaccaggagtaagaatacagggtagctgtatttgttatctattgctccataacaaataattccagactttctggcttaaaactactcattatctcacagttcctttgactaggaattcagcatctctaatttaaggtctctaaaatgaggttccagttaagcgattgacagggtctgtcgtcttatctcctgataagactaggaggcttgactagtggaggatctgcttccaagcttacttgtggggtctcagttttctgctgtctgtgggccagagctctctttcagttgcttgctatgcaggtggcctcatgggactttctcatgacatggcaactggtttctccatggtgaacagtctaagaatctgtcaagatagaagccacagtgtttttataatctaaattggaagggacattccatcacttctgccactttctattggtttgtagtaagtcagaaagtctagcccacattcaaggaaagaggattatggaagggcataaataccagaaagagaattttgggtgactcccttagaagctgcctatcaaagtacttaccctgccattctgtctacttatcattgtatttctctttaatttgatcttgaggttgtaaagtggctataaactttagccctgccctgatggagttccaggggatttatttggctgtgggtatttatgatgtgcctttcactggatacttctttatcctagtggataacctaattcctgtgcctaacttgttactaggtatacttcacacacacacacacacacacacacacacacacacacacacacacacagacacacacacaaacacttatttatgctggcagactgacagtcacctttgcagctcttgtctgttctgccaagatagtcactctctgggaaagctttgaccagaagaaaaattgggtatggatgtattggtcaggagacgtagagaaggcagcacagcaaaacatatgaagtataagaagcagtttattactcatgagtccacgagagaagacggctactatataggaagcagggggcaaggttgcaggggcaatgtgctgaaccatcagatcaggagcagatagaaagaggacctgtggggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagacaagatttgggactacaaaacattctcgaggtagtgttccaggaagctactgactgtcaattatttaggattggaactccatttgaaatctatttgttctttatattgtttttttttaagtttatcttcattaaaaagctgcaaattaggtattcatttttttattccactttggagaaaacaacaacactaagaaatgtcaaaattaatcattgatatatttgtgaccagtaccttcaaaactagttcaacctactgaaaactactcaagctctttccaccacataatagcactttcagatattgtttttgcagcttaaagggaatttgcatttaggtatgtgtacaatatcaacaaattggtgctacaggcacattcaatgttcttctttttagaggaaattaaattcaatttgattaggttgatgtggacaacattaaaataaatgttaaccttattctgtatttatgaatcaatactgatagttttaagatacctggccattctacttgttggtaaggtcttggaataaggaaatcttgacagaagttttgaagagtatattctttatcatttcaaactgtgaaaactatgcactttcctaagagtagattttaaagtcacacaagggatcatgctgaaaactgacttctagagtctttgctcagcaggttgttgcattttttttctttactattgaacactcttttgttcatgccttttttcttattgcttgcagaaatgtgacaagcttcaaacttacacagaaagaataagtagtagagatactaggtatcattgcacagcccagatgtcttttgaaaatatttattcagctgaactagaatttcaaaatctattagaaaggtaaaatatatcttggaaaacaaaagcagattttgaataaaacataggtaaaaaaacttttaagtaagaaaatatgaaaaaatggcaacagctttaaatgataacttgatggcttccacagaataattcatagtgtaggtattttttattaaaacttgacaaatattctaaaaaatgtaaaagtgaaaattaggtattttaactgagaaagatgaaattggcaccatctaaaaaaattttcatgagttccatttgtgttaagaaaatatttcttatttaatcaaatacatgtgcaaaatgttatcttaaaatccttttagagttttgataaagaatgctcaatatgagcatacatattcagccattagttatattcacattctcttccagaaataatctgttaataattaaatgtgttttataaacacttacataatgaaactcaaattagcttctcagataaattgttgttgctgttgttcagctggtattgttataaaccatcattcatataactttattatattgtgagtgttttctttgaaactgatcaacctcagcatttaggatatgtggactattagatggagaaatgaatatttgccttagcatagtaataaatattgttagactgacacaaatattagcctgcactcatagtgcctaaaataggccattccagtaattgcttagaaaaatattatttgtacagcttgtagaaatttacaaatgaacagaaaaactctgcatttgacctaggatatatgaattcttcaaataataaatatatcaaatatattctgagtttgaaatagtctttaccttgagccaccaaaaaggaaaagaaaatagaatcaagattacttgttaattttcaattttggggtgaaaaaccttattaaacttctccagtaactaaatcacataaagttcttcagtacaagttagattgtggaaatagttcatgtagttattccacgtctccttctaacaaaatatcaacagttcaaatatccagtttccttttcatttatgcaccattgtagttgctaatataaatgttggatctttctgcctcccactcacacctccagcccctcccctgcccacgcacctgcactggctcacattggtgctctttttctgcgggctgcgctgagcagaaaaggtgaggctattcagggttctgtaatgctcaattccatgttccgtttcttttcctcagaaacagttgaaacctatctatggatgaaaaacgcttcataatccaaacattacttcaatcagatgtgaagagtgggtttgctgcactgtaacatgctattattgcttaggtttatttgacaaaagtgaacaaccacaactttcaggaaaaactttttttttttgaattttatgtgagttgtccttttggaaatagatagatgagagagagacagagggacaaataatctgtatgaattttggcttttctcttgagtataaatgtttatctttcccccttcaatgtaacttgcttggatgttcaagtgtggagtacatttcttttctaaaagacaacatatttttcaattttattcattgatttatcactcaaaacatgcacttgaaggtactcttagtactctccttcatggccagtttatctataccgttttttcagagtttcttgagacagcttgcttttttttgtttgtttgtgttttttgttttgaccgagtctccctctgtggcccaggctggagtgcagtgatcttggctcactgcaaactccgcctcccgggttcacactattctcctgcctcagcctcccgagtagctgggactacaggcgcccgccaccatgcctggctaattttttgtatttttagtagagatgggttttcaccgtgttagccaggatggtctcgatctcctgacctcgtgatccgcccgcctcggcctcccaaagtgctgggatgacaggcgtgagccaccgcgcccggcctgaggccgcttgcttttaaagagctctcgcaaacaggtagcataggtgactgccttttgacctaaaatgtgatattttagaatatgttactagaaatttgcaataatgttcttaaaattattaatcttattgatgtgtttctggagcccagtaccaaacactgatcctaaagattgaatttggaacgaggccaatttagtgtttccctaaactgttttgggtagaacgctaataataatgccatgtgcttttactagtatttcatagccaaatacatttggggattacagagttagcccactcgtagccgtcttgtggactgcacggagcctttactgtgcttgcatgcatcatgcacccacctctccgagagtggtgtcatatatgtccattgattggaatgagcaggttactcctgcttccctctgtagagcgcatcatgcagaattgtttgtgtgtgtgtgtgtctgtgtgtgtgtgtgtgtctataccactttggatatcactcagttaacagttattgtctaaatcattcttgtgataagaatgataatcttattatataaatgatagaactatacttgagaatacagcctgattgttttatctatccattttatcattaaaagtgaattgaaaactttactattatgaaccctgtcgtttcctattgaggttctttaacactagaacctgcagaattagccatactttgacattaaaactattacattgccatcctctctttttccctggtgaatatttaggtgcactttgagatctggtattgctctagtggtgtgcctatttttttttaatattttcatttttgtttaatctacagagaagttccgagatcctccagagctctgatgggaagaattgtatagcgtgtcccctgccaaaagttctaataaaaaatttacacagcggaggctttgattaaatgaattattcattgacaactatccatcagggaattagaagtttatggcaacatgagctgtggaaaatagaaagaaaaattacccattactaactttttaaatgagaaagtcagaaactcagattgaatgtgaatttaaccctgcacatggaaagacactatgcaaaatattgagaggagttacataacctttatgcaatttattacttaataagcacataattggctgctaattaacagttgtagcatctttctttcttgtctttcctctcgttaagcgtaatattatgtgtagaactagcatagtgtggtttctgactttaacattcttctgtaagatcacttgtgttcagcacctcgcacagggttctattcacagaatagaatcctattttgttttcttttatattagaaatagtccatggcatcttgacaaggtgttatgaaccagagaggaaaggtcaatgatttaaaccagctttaggagaagcatatatagaagttgtttctcggctttctggaatgaattttaacagccacctataattgaaagcatttcatgcagggcatttcacaaaatggacattcaaaaactacaggttgacctgtactgaagacgtgaaattgctttgtgcctttgagaagtactcttggataaaccatgccattgtctatattgagttccctgattaaataatagtctctctctatctctttatctctctctagctagccatccatctatatatataacacatgcacatactcaaataaatatttacataacgaatctatcgatgtatattagtaagtactatgcattcagcacatgattagggtgcataatctcatatgcacgttgcaaaaatctttgaggggtagtatcattagtaatatttcatatatgacaaaactgaggtttaaagagtttaagggacttttccaagttcacatactaagagaaacagttactatataagtcacgttagccgcaaaggcaagcctttcttctttttttggatattatataaaaattatatagaaaagtttctttttaaacctaagccatgggaacaattcttcagttttcattttattctagtaaatttcttttcttttcttttttttttttttttgagacggagtctcgctctgtcgcccaggctggggcgcagtggcctgatctcggctcactgcaagctctgcctcccgggttcacaccattctcctgcctcagcctcccgagtagctgggactacaggcacctgccaccacgcccggctaatttttttgtattttttggtggagacggggtttcaccgtgttagccaggatggtctctatctcctgacctcgtgatccgcccgcctcggcctcccaaagtgctgggattacgggcgtgagccaccgcgcccggcctattctagcatatttcaactcttggtggcagaaacatctttcttaaatttcacccagaagtgaattacatgcccaccctttctttttccggatggatatgtggagagaacaattatagttctactttgctcttggctgtaggtatagttgttaataattagaaaacactcgaatggcaggttgccaattagagaggggagtataaagatacacagaacccgggcaattcaaatttgggacaatcgcctttaaagacattgagagttcactaaggttgctgatgaatcctgtcacttgtatcagtcaaaaggataatttgtaaatagcctgtagagaatcaaaggccagaatatactctcttttctgacaagcagaaaacacattatatgggctaattttccctgcatttttatcttaaaaaaaggagatgggtttctaattctgcaagcaaatatatattttttctaaatgtgagctatttcgaaaaacctaaaaccactcatcctagagcaagaacagggctaggttgagtgtccaagagaagactgtcacaggacctggcacattagtgagaaaggtgacattactccaggggaacttaatgatgccatttatttcttgatgctctgaggtacagcccccatttagacagattactctgagaattttgtaagatatccaatgagatacaatcatctttattggtggcactgtaaaggcaagtatgagagattttggcaagatcatctttttttagagacacatttatcatattcctttttaccttctttattaagtaggtactaatactatttctgattcactgctctctactccaaggattgcactaataggaaaattttcataaagcttttggctaagaactcctgctattgacctatgcccctttgtgtctaggttgatccagaagatacttcagcataaaaataaattccaacaaaatttagtttcaaattataaaagttgatatttctgctttatttgtccaaaagaggttctaaaatgaaattttctcaatttcaggtccattaaaaagtctgaatcttataaatatgcatagcttttataatacttataacttagatattaagaaaaatcaagatgtacattattaaagaaataacatttccattgttttcctttctcagaagtgggataaacaagcactgtaaactgaaataagcaatgcattctcagttccctcccaaaagaaaatactggtgtgcctgacttaccatttcagaaagtccagaaaacgctgcaaactaggcaggcagtcaagtgcaatggcaatgaataaccttataaaatttccagactttaagactgtcagtctggaagactacactatcttttagcacaaggtacttttggagattactctagggatcttagagaataattatacttaagtcctgccagggcctttttttttttttttttttttttttttttttactgtagtcaatagtacttccattgtactccttacatgacattatgttacagaagaaaatgttttataacaatgtcatttgagtgcttcagttgttacctctccttgaatacatatgaaagaataattacctttgtagtaaaggacattctagttatacatctatactttattggtttcttcatgtttttctcttcagaagtagaaacttaatgaaaatattgcgtaagtagagagcagtttatgacagtatttctttctaaataaattaaagattttattatatcttgaaatatatcacatatgtaaaatattaagtataatgtttgtgatcattttgaaacacagacttttaaactttaataaattatatccaagtaacattttaaatttgttatctaacttctactgttaacatctgaaaaaaattagaattggcagacatgcaagatgatgttgactttgcagccagaaaatgtggaaaggcctcaattagtatccctgattcacacttacaaatgggtgtttcagtgctgtgcagtttgataaggtagttaaggccatagtttgggagacagataggcatggattccagtcctggctcaggcatttctacttacgctattcgggcatgtcagtttttctttctaaggctcatttccctgtgtgtccatgaggaaataatgtgtttccttggtagaaagatggttgtgagggttcagtgcaatcatgcatatgcatagtaagtattccatatatctcaatatcatgatttatttcttgctacacaaacttacagtctactcactacctttgatgtaaagctgtcccactgtccttctgtgctttttctagaggttgagctcttccttcatttctggaatagttactgatttcaccagtaatttgccttttagatccgttgttacaggtgcctttttgaatctgactgctcaaaagctttgtccattttgtgttgctataaaggcatacatgaggctgagtaatttatgaagaaaggttttggtgctcatggtcctgcagactgtacaagaagcacggtgccaacatctgcttggcttctggtgagggcctcaggctgcttctacttatggtggaaggcaaaggggagctgactatgcagagatcacatggggagagaggaaacacatgggggcaggtgggtgatatgccaggctatttttaacaaacacttccctgggaactagtagggtgagaattcagttgccccaagggaggacattaagctattcataaggaatccgtccccatgaccaaaacacctcccactaggccccacctccaatattggggtcaaatttcaacttgaagttggaggagacaaacatccaaactatagcagaagcctttttttgttttttaaagctttagctttacctgccatatataatagttcaagcataaaattcaatgtcttttagcttttttagagttgtgctgccatcaccataatgaaactatgagacctttcaaagagaagacaggtgtaaacttgtgttatctttgattaggttatgatttattagatttgacaccaaaagcgcaagcaatgaaagagaaaaattcaagttagacttcaccaaaattaacagctgatatgcctttaggaagcatgtaaactcagaagccattcttacatgactggctcatggacatcattgatttgaccagaaatggacattaaaaccatgggaggctgatgcagtctctcatgtatgaatttgaaatagacacaagggaacaccatgaagagaatctctgtggaccttaacattttcaaattttagaaaacaacattttactatgtggaatggacagggagagtgtcaatgagaaaaacaggaggaggaggaaatgaagagagtttggcttaaaatgttaccactcaaaatgcctagcatgaattggggcaggtccatgaactgcttgttattggtctctacccaataagaagctggctccagaatgcagttcagttgacattttcttttgtaagaaagattttctcaattaaaaaaaatcaccgtgttgatttgcgtttgatagaatcttgtcatcagacaccagaattttgggtagcatttttcttttttttcttttatcttttttctttctttctttctttttttcttcttctttttttttttttttttttttttttttggagacaggatttctgtcgcccaggctggagtgcagtggtgcaatcttggctcactgcaacttctgcctccttgctttaagcgattcttatgtctcagcctcccaagtagctggaattatagatgcagggcaccacgcccagctaatttttctatttttagtagcgacagggtttcaccatgttgaccaggctggtcttgaactcctgatctcaggtgatccacccactttggcctcccaaattgggtagcatttttctagaatattgacactttaagctttcttatgatactcacttttttctttcctacactgttatgcccagtgggagaaggttgcttctcttaatagttctcagtaaatgctgattaaataaactgtagaagggtaaatagttaacaagattctgaatttggacttgtgatttttgaggcaaaaataataggttgaaagacatgttttttggatcaacaggcttgtatggaggtagacatttataatcttagtcatactagtgagtgatggacattttattactgttttgcaaaggtatggacaaagtcttaagatctatgtcttctacttttaggcatgtaggtaaaaatgtcagtaacaatgcagaaagccagtttatctatttaaaaaatgaatatattggaagccttgaatatgaggctgagtaatgcaagcttttcccaggagaactgtgacttcttgaggcccaaagctgcactccggaattataagtcctgagacatagtctataaacaataagtaaatatcagtcctatagctcagtgttcaccactgatgacttctcacacataagcaatatcatgttaagcagatagatactcatagtcatccaatagtttgcagtgggaaaatagtttgctaaaaagcaagatgtcatatgtgttgttatatttttcacacatgttgagaaattatctctgttgaagatttcttgagttaaccttggggcattagcctttgctgcaaggtttgaaaaactcaatttttcccattcagtgtgatctattacaagctattctgcttcctgaatttttgagagtattgctagttattttattctcagttacctaagaagggtcatatgagggaatgttttgattatcctaaattcgtttctatggataacttcatatctttgttcagatctgatttcttccatagtcacttaaacttgagaattctatcctatcttccacaaaagctatcattgaaatagctgtgctttccacttaaaaagtgaaaaggttaatggtatggagatgaaactggaatccaatcctcataaacagtactgtcttttccatttttatgttgcctttttggtcacctagaccatacacaagagattttatttttctttttgtctgattgcttctaaacagatttctattacatctccaaatttcagtttctctcccactgttcactctaggataaagtggagttcttactttatttcaatagaagctagaaataggtaccttaatgaggcaactcttgattttatttcagaacttggtaaaacttcggcttttcatttcaaaaacaaaagtaagcctctgtgcttgctgatctgtgttccgaagacttattctccctgtgcacccactatttctactagctagaagtaaggcagaattcccgtagagtaattgtgtttcagttgtatttcagacaccacagacatgaaagcttcacagaaaaggttgcttcttcctcagtggagctcatttggtaatagatgccaggtgcatgactgatgctggtttgaaatggaggacccagtaatggctatatcgcttggtgaaatcgcatgagctcaccagaattagaatatgcccgtaggagtaaacataacttctcatttttgaaaaattcgtaacttctcacaacttttgttgttctcattgctattgatattgttttaataatattcatctctatcagtgcccagcaagaaaatatatgcaacaaatattagttgaatgaatgttttaatccacacagtaagagccataggatataaatatacatgatcaatattccactgcagaaaccactggatatcttaaaacattataaagttacgtgcagaaaactattgctgtgctttatgattttaaaagtaaggtgtatttataataaaatatttaaaaatactgagaaattttagaaattttaaaatagtgacccaagaataatctttagttttagtattaatttttacatatgtacttaaaaattactgttgttgttattattattacatttgtaaaatgcaattggagtatattcattactttaaggtaggagtggggaagtggtttacttgagaaaaatgacatctagttttgtactttttctcacgctaagaagtacgtagaaacaagcaatcaactgaataactttagtgtttatttttaaaagtgatatatatcccaacaacttgtaacttattctttaaataacagaatttaagaaaatgaacaatattagataatattacataatagttatgtctcacttttagtatttttgtctttctacatgtatgaattttataattaactattacaatttttagacttccaaactaattttcatgattttggttatctgtattggggtacaatttacatacaataaaattcaccaattttacatataaaatttgattagttttggaaaatgtgtggtatttgcccctggttttctgaaaatagaattaaaaacccatcaaatcttttatcccccttcatctcacttccagtagagatatacttcttacattttatacttataatgtcttacctatagaaactgatagaatagggcctttcacaatactaattatttcatttggtgtttacagccaagcagttttgctcctcagaggatcttaactgggaactaaccctcatctgtaactatagtttctcacaccatcaaactttacttaaaatgtgccagagcctagttaaatgtcaaagaagaggcctggtagcctttgtttggaaatagaagacagtatctactttgaagttattgtttctaaccaatagcatcctcggattttaacatttttgttttattttgtttcagtctcactgacaaaatacctttcccattttgtgccttaatttccggtttgaatagcaatatcttagctcaatctttaaaaataagcactgtttttgtcccttttactgactgtttgctttttttaaaaaaagtccaaattagtttcaagatcaaacttctatgtatatttagaatctagccttgaatatttcctaatttatactgaattccatttatgtatcattcttggattagattttctaatctggccatgtttttttctttcagacctgttactagctcactcttttctattcaaatcttatttctcatcctggcctatttcccaagtgcaaagacagcggggcttcctgtgtcttagggctgcccagagctgatgcatatcactcaattacggtattataaataatatttttagaagtatataataaaaatattaccaccttaacagcttaaacctgaatttgtaatcaggttagaattaatccatgaaaaactttgtgatatagagcattgtgtttttctatgcacaactttgttgaaattctagcacttgggaaatgatgtctactcaagatttacattggctaattcttctcatactaattatttttactatgttgattatttattgttttatattggttgatggtttttcttgaatgctcaaataagcagccattcttgataactattgcttatctcagatgtgaagtatataataacattttattactggttttggttattggagtttattttaactaggattttactcttagttcagtttttaattcagtctgaaaggtattattaccaggtaggggagaggtcaaataacgaacattattttccaatcattctggcaatctttaaaaatgtggttccctgagtatgtatgtagtcatgtaccacgtaacagtgtttcggtcagtgatggactacatatatgacagtggttcaatgagattttattaccatacttttactgtacctttttacatttaggtacaaaagtacttaccaagtgttacaactgcctgtagtatttagtacagtaacattcacagatttgtggtctaggagcaataggctagactgtatggctcaggtgtgtaatatgctataccatctagatttgtgtaagtgtactctatgatgtttgcacaatgacaacatagcctaacgatggacttctcagagtgtatcccggtccttcagcaatatataactatacatatgatactgggttgtgatcatttcccagttacaaacaaattagctatcaattttctccataatatcaaactcttatgtgattctaagtaagtaattggcagaaaggagaattcacattagtttactgaaaaaaacacagtgtagttttatgaaatcttgcctgttagtgatataccctattcgcttttgttgacaaaatgcaaattacttctttaatattactcttctccataacattctgatttgtttaaccttgtcatgtttctgttaaaccagttcaacagaaagggctcatccacttataaataatgcattatctttcaaaagccctagtaattttttgcttataatctctgggtagcttcagtaagtcaaaacatgacttcatattctaacttgtcaaacttttaagcatcaagcaatttttcctgcacttttaattaactgcacaaaatattatctgtaatgaatagatatgttaacaagttatgttagaacaggacaagactagcttttggctcagtggggtagaaaaaagtaaatatattcttattgctgttgttaggaggtagctatgttagaatgttgctatggaagagagatgctactgaattgggtgcagtgaggggaaaacatgggagttaaaacatgtgggttatacacctatgtatctaggataccatgcagaagaggttggaattagactgatggttaatcaatgggataaagggatgtgttttcagtccttgtcagatgaatttctactttatcctctggattattggcccttattcttctttcccttagaacttatcattcttcaaaattacaattatttctgtaatcatatcaaattatcagcttcttaatgatgtttcttacccactgtgttttagcatctaagatatggatgtgtagctaattgtcataatagctaactagcattcattgcacgttcatataatgtccagctctttgttaagggctgaaagctcattatctattttaggccccacaacactctgaagttggtattcttaggaattctgtgaatgagaaagctaagacttcaggaatttagtgataaatttaggtaaaagttagagcaggcccaggacctacgtctctctacagtgacatacatgccctgaactgctactccctctctttctcacattacctaggcagcttttattgtgctttgttatctttaaaatagcgaattaacacttgctatttcataagcttaaagatgcattgcctgtaatattggaagctgatatgcagctcaccacatatccaaaggccggtaataatgaacgtaaaatagggaagaaaagacagagtatactgggatggatcattatctctacatgttgatttattttaaaagttcctttcagtgtatattaacaccttggaatgtgtgcaagttacaccggtgacctttctgcatagaactccaatgagagaaaaggcaacccattgttagatgaaatgcttttcatttcaagcatgtaagcagtaccacacttggtggattaaagatcgattgatctcagcaagcaaagaacgttgttaaattgttcagtcctcctttctggctttctctttttgctaagaatggaaaaagagaaggccttggtctctgttgtctcagattcttgtacctagggctataattgctgcagataaaacccaagaacaattgggttgtggttttcaagtttaattacattagagctgcttcttttgccctatagtcacatttgcaatttgtgattaacatattagtgggaagaaagtaatgatagattgtagttaatgaagcattttctctatctgttgtttcttcaatgcctctttcccgctacaggataagatatttatgttaatttttatgcatgctgtagttaggtttctatatattatgtagggaaagttctgcattagctctaataaataaagtgttcagttttaaatcatggtctttgctctactttatttatttgtatttactctttttcattactgcaggaggaaacagactcagtgttttatttttataataaaatactcttactctaagaaagagttattatgcatcctaatactggtatgcaaacatcattaaagtttacacagcaatggtttttaataacatttggagatattttggctgatgcagtttttgtgctaatattttggcttcaagataagaaaaactggatttaatccttgctagaatgctgggaaaaactgatgttatttgtaaatgaagatttaaaagcatttaactaagcttcgttttaagatatacatgtagagccacatctttttttttactttggaattttaaaatatgatttatcttcctttgtcaggtagactccagagtttaaagtgaaatatatatatgtaatatatatataatatatatatattacatatataatatatatatataatatatatatatataaaatatatacagaaggctgagaatcaaaccagtattgaagcattcttaccaatggcaactgggatagtgtttgagaatgagattgtggggtgtgtgtcgaggaaggaggtaagggtgtggattaaaagttttggaggtgagatgatagacaaggaagaaaattttattgttatatctttccttattgaaattgctcattagtttgaatccttccactgttgtctggactccccattaaaaaagaacatgatcactgagaaagtgtctaatttagatgtgcttttgatagcaaaataattataatagacaaatccttgaaaaggaatttccttgtcacatgacactgatatactacaaaacagttgtgccatggcagcttataatatttaagtttcctgattctaggtacaaagatctctctgtgaaagctggccaaatattcaagaatgtactgaaatattcaaaaggtgtacatttatgatctagaataattgataagagttgaataattggattgcttcactagggaaaggcagaaaatgtatgactgtagagttaacattcttgagattattaaggaaatgataaagataacaatggagaattcctttcagtgtactaaaagttagggaagcagtggaggcttttgctgaaatttgaaagagacaaatattgaggcaagtgaaaagtaatagtcgagtcatttgagatatgtgcattttactctgtcagttttattttatttttaattaattttttaaaatttcagtagcttgaggggtacaagtcgtgctgggttatgtggatgatcgtacagtggtcaagttttggcttttagtgtgcccaacaccaaaatagtgaacattgtattcaataggtaatttttcatccctcacctccctcctgaacttctttcctctgagtctctaatgttcattatactactatgtctgcctttgtgtacccatagcttagctcccatttataagtgagaatgtgcagtattggttttccattcttgagttacttcacttaggataatggcctccagttctactcaagttgcggcaaaagacattattccactcatttttatggctgagtagttttccataatgtttccgtggactcatttgtcagtacccaaatcagtagcattgctgtgcaccaacaatgaccaagctgataatcaaagaactcaatcccttttacaatcgctacaaaaataaactaaaatacctagggacatacttgaccaaggaggtgagggatctctacaagaagaactacaaaacactgatgaaagaaatcatagactattcctttccatggaatgataaggaaatggtatttccattttatttatccacttatctattgataggcacttggattggttctatatctttgcaattgtgaattaggctgtgataaaaatacacgtgcaagtgtctttttggtataatgactatttttcctttgggtagatatttggtagtgagattgctggatcaaatggtagttctacttttagttctttgagaaatctccatactgttttctatagatgtttcactaacttatatttccaccagcagtaggtaagtgttccctttctacgacatctgcaccaacatttactgttttttaatttaaattttttttttcataatgaccattctggctggagtaaggtggtatcttgttgtggttttaatttgcatttccctgatgattagtgatgttgaacattttttttctgtgtttcttggccatttgtataacttcttttgagaaatatctgttcatatgattatctcaatagactcttctgagtctattcaataaaattcaataaaatccaacatctctttatgataaaaaccctcaacctggtcaggcgtggtggctcacacctgtaatcccagcactttgggaggccagcgtgggtggatcacttgaggtcaggagtttgagactagcctggccaacatagtgaaacgctatctctatttaaaaaaatataaaaattagccaggcctggttgggggggagcctgtaatcccagctactcgggaggctgaggtaggagaattgcttggacccaggaaacgaggttgcagtgagctgagatcatgccactgcactccatccttagtgacaaagcaagactgcctcaaaacaaaaagaaaagaaaagaaagaaaagaaacaaacaaccgtcaaccaactaggtatagaagaaacatacctcaaagtaataaaaaccacatatgacaaaggcacagccaatataatactgaatggggaaaagttgaaagcattcctcttaagaactggactaagacaaggatgctctctttccctacttctattcaacacagtactggaagtcctagacagagcaatcatgcaagagaaggaaataaaggacatccatattggaaaagaggaaattaaactatctctgtttgccagtgatatgatcttgtacccagaaaaccctaaagattcccccaaaacactcccggatttgatcagtgaattcagtaaaggctcgggttacaaaatctatgtgaagaaatcagtagcgctgctatgatacaatgaccaaactgagaataaaatcaagaactcaaccgcttttataataactggaaaaaaatgaaatacctaggaatatgcttaactaaggaggtgaatgatctccacaaggaaaactacaaaacgctgatgaaagctgacacaaacaaatggacaaacagacaacacaaacaatgggaaaagcatcccatgctcatgcattggaagaatcaatattgtgaaaatggccatactgtccaaagcaatctactttggacaaagattcagtgtgattcttatcaaaatgccaatgccatttttcacagaattagaaaaaacaagcctaaaattcataagaaaccaaaaaaaaaaaaaaaaaaaggaagaaaagaaaagaaaaaagagcctaaatagccaaagcaattccaagaaaaagagcaaagctggaggcatcacattaactcatttccaattgtactaccagactatagtaaccaaaatagcatagtactggtataaaagtagacacgaagaccaatgaagcagaatagagaacccagacataaagccagatacttacaaccaattaattttcaacaaagcagacaaaaatatccactggggaaaggacaccctattcaatacttggttctgggaacactggatagccacaggtggaagaacaaaactagatccctatctctcaccatattcacattaacccaagatggattaaagacgtaaacctaagacctgaaaccttacaaattctagaataaaacctaggagaaacttttctggacattggcctaggcaaagaatttatgcctgagaccccaaaagcaaatgcaacaaaaataaacataagtaaatgggacctaattaactaaaaaacttctgcacagcaaaagaaataatcaaaagagtaaacagacaacctacagaatgggagaaaacgtttgcaaactatacatccaacaaaggactaatatctagaatctacaaggaattcaaacaaataaacaaggaaaagaggccaaataattttattaaaagcaggcaagtgatatgtaaattgtatttttaaaattataacaaaagagtgaaatctagtaaatgttatacctcttggtgtttaggagtgaagtgtactgaggtcttgaaatgcatccaaaattataagttagctttcaatgttcaagttaccttgaaatgtgtccaaaattaagatggattaattgacgggtggattaatggatgatagaggtatacatatgtggataaataggcaggtggatatgtgattaagcaaatataacaaaatattgattctagaatctaacactaggaacatggctgttcactgtgcacttctctcaactttcctttatatttgaacattttcataatgaaatgttctttaaaaaaggaaagctacctgagacaaggtgagaaaattcttaatgcctattcaggtaatactagctgaaaaattgaaaataaactttaagtggagatgattgtcttaatcccaaagtattgctgacacgggatttgttagcatgtctctaaggtgatgcaccatatattttggggaaaagcatttcattttccctgtaaatcatggtgcatcaataatcatgcacttgcaacaagattgtctctgacttctctaacactctagcattgcttatgaaggacattcttctatttggccaacaaagaatatttctgtcttatcttaaaacagagataaggcaaatcattttgacagtctctgaggcaaggtaatccctgctaatctactcatctttctacctcttacatacaaagaatgggctagagtttgtcatgggaccacaggaatcaggctttgtccctgagtttattatttttctgaggcagggtctcgctctgttgcccaggctggagtgcaatagtgtgatcacagctcactgcagcctcgacctcctagactcaagagcttctttcatctaagcctccagggtagctgggattacaggtatgtgccgccatgcctggccaattttttattttttgtagagacagagatctccctgtgtttcccaggctgatcttgagctcctgtgctcaagcaattctcctgccttgacctcccaaagtgctcagattactggtgtgagccatggcatcccacctctgcttcattctaacataccacttcttccctgtttcccggactaaatactcaaggtcattaatagaacattattaaatttgaagacataaaaattctaactttaagctttactaaccaacataacatattgaattttccccaccacaaatttccaatagctggtaaattaatggtgtgttttgtctttcatctttaaatattgaatgaagcacagttctgctagatactcatatcacaatacatgtcttcagaaacaatttatatgcccagtgtatcaatatttaatttatttacacatttttttcatcactacctttatttgaatgatggatgtgttgatgcctaagcccatttatcactaagaatgaaataactaccactgggaaacttttgggaattatatatccatgagcttttcagaactgatcttttgtgacgatggaatggtcactgaccagatccttattgtagactcattacttttgaacacattcatcaataccaaggctcgggtggctgctggatgtcacagatccatagcactgtgccaccacgtgctccctaaaaatctattacatggtttagactatgttttcccaagcttaaacctaggaaaattgattgcctttcccataagtttacataatcagagaaacccagaactggaaagtattttaagcattcattcaggtcaaacatttgtgttctaatagaactttcttaaaatatccaatacaggcaacagcaggtcttattctaaaatatttctggaaaaaaattattccatttagataatgccatgtatgtatccagtccttcactatgtgcagtggtaactagtctaattttaattactgctctttaagccagtattcacctaaacttcataggaatgaatcccttcagtaacatccttatagtagacttcatatatttgtaaagctacataactacatataaaaccaattatgttttttcctagtcatttttatttataatgcatagtctaaactcttttgattttattttagaacagcattatttaaactttcttgctaaatagtaccagagaagcctagaaactcaagaaaaactacttttgaaatattcttgggatctaaatttttgtctttaaaacatgccacataaccttttctcatgtctccatactgaatcaatgcttaccttaaaacaccatattttaacttatgcattagatagaacacttccacacatcaaatgttcaggtaaaatagattatctgtgaacagacttggaatttattctgctgcttgccaaatccttgccatgctgctgtttcctccaatgtggtatgtgtttaaatctggggagcatactctcagtacatcacaagtatagcctattattattgttgttgttattgatgatgctattggtttaccaaaaataatttcctgtgatactaagcacatggctatccaattgaaacacttaacttttactgaggatctgagcattgtcccatggcatattaggatgtgttactgctaaatacccttctgaagatggtgaccgaatccttgaaatgtgtctgttgtggcagtttgaaagacaagtgaacgccaaggtcaggctatcactcagtgaagccaactggctggctgcccacgtttctcataacatttcatttattttgatggattcaccaaggtatgagccctggcactcaggtttggggcacagaaactttgatgtttataagcacattaaatggttccatctctagggtacagattcacattaaccaagggcacaaagactagcaagtaagccacagtgccaaaggataaattgataaagaaaagaaaaatggccttgcagctggcaggatgcgggtcagtgcggtcaggcccttctgtccctgttggcaggtatttcagaaaagctaaatgaacatccagaagttgctgagtgagtgaacatgaaatcaggaaagaaaaaatcagttttatgattaaggtatttagtagtatgaaccgaatgtttccttatccattcatttcttcatagagactcacatatcatggaaatcagagtgggcaagagttgggagggcaatgatggtatttacaccttccaattgttgcacagcttctatagatgtattcagttaaccgtgacgtaggcagtgcctttctctgtagtctgggaacagttctttttcttatgattcaactctgagaaggcagtgctttctttttttcactattacaccatcatgtggtgtaggtgagcttctggaaagggaagaataaaagaaattatgttaactgttcagaaactgtgtgatttagtaacatagagcttcgttacagtaatgtaccctgtaagtggaaagacaggcagtatgggtattacgaaatgatttttttttaatggaagagaatgatggagaaagagacaaaggaaagttatgttagagtcataaaccctgcatgatcctgtaaaaattcatgcttgatccctgcagcctgaatcaacatggacatcagtaaatctctactcttgccgaagaaacaaactaaggctataaagaagtactttgtttttgatactcattgtcttccctgacagccaagtcaaaagatggagataaacaatgagcgattttctaacatgaaaaacaagacaagaaatatctttcttataaaggaatccactcagtctgttagtgtatatactttgccagtcattcctacctgattcaatgaatatttattgattaaagatctagtcttgtgaaagagacacttgaaactggacaaacagatgtagtttgttaagtgctaccagagggataagccaaatgccatgagcagactagggagggatgccttgggagcctcattgaatcattctgaagaagtttgaaaggcagtcatggtgtgggtgggcatgcatttaactagtaggttgacctaggagggaaatatgcttctgcttttagagattaatgaatgtatttatcaaatgtgtattgaaattctaatgcatatcaggcttcgttaacactatggatacactgagcaaaagaaatgagattcagctcacgtacacaagtaggtaaatttttgttttttgtttttgtttttttttggattagcttttgtaaatttacatctagaagtactggtattgttttgtactctctctttcttttgttttttgctttttggggggaaggggacttccaaaatggtattatgacttttcttctttgaaaaagagttcttaaatttatcttcaaaaatctcttgaaaactagaacaaaatgaaaaatgactaggactgcattgttaaccttatcaattgtgactatcaatatggaatccttacacctatgtagtttatgaaggcaaagcctacagttagtttgagacaactattaagcctgaccaaattctcagaatgcttttatgatgctaataagtatcactacaaaatgaattgatgtttctcatgcagccaaagtggcaatgattttacaggagggagaggcatgaggttggttatctcttcctggcagatgggctgtccctccccaacccctcctcccgacacagacacaggttggtaggattttttctacctacaggttggtaggattctctgggagaatgaaaatatttttaaaaagcaaaacaaaggaaaactcttaatttatatttaaattacccataatcgaatgattcacgcaaaatgaacttttagagcaaacgtcttttcaaattgtatgagggatggcttatttttaactaacggtactgacaggacattctggggactgctgcagatactggctgctctattcacaaagactagggggaagaaaaggctgtcttcagtaatgaatggaaacactgactggctttgaggcgagtaattgccttactcacccacacaaaaatttcagccagaaaagtcctcctttaagcagagcacaaatgatgtgaaatgcatacttgcacagatatagtataacttaccttgagtttatttaattattcctggtccatgggatttttgaaaaattgccagaatactacttttctgcagatataaataaaaggtccaaatgttgcttaacttcttttttcctgaattgcatagtatatatgtgttagaaatggctaataaccgtcacagagtagttgagaagttaaaacacacacaaattcttaatatttctaattaaaagcagcataggaatattgattactacagtggaaatgtaatgtgttctttctttcctttttaaatgcctatatggtacttattaacacttttaatggcaaaagcaataaaaataattaaaagcacatttagttcctgttctgcctcatttcattaatttctgcttttttttcttttggagaaaaagttgtaaaattgatgtcttagctgtagctgcctctttatgatattagatttctgtatgtaaagaaggtattagaaaaattttctcctgcactcaaggaatctttaaacttaaaataaaaagtgattataccttctattttcaaggcagaataaaaatgttttacaatgaatagaattcttgattttcaaagaagtttattacatttgattttgtcagagttaataagtgataataaataaatgtgtggaaaaataaacttttgaactagatcaaatgtgtttgtttctatttcagtattggctttgatgcctaagaaagcaaaatatttatctactgaaagagcttatgtctttgtggcccccagcttttcctctggtgagccttaggaaaaatggcacttgctctggaggcagggaggaaactccagatcagacccaggtttctggcttgggaggtggtggtggtggtgaaggaagtgcagttggttaagataaggagatgaggtgaattgccaaattttcacccagatgctcggcggcctctaaaggtcggtggtgttaccaggcgcaaattagtaatgctggctttgaacttaccttgaagctgcagtgccacttgttcttttcatgcagtcgtatttcgccaatggctttttactattttcttaacctatgtttggcatcttacctgactcctgggcaattacaacctttaaccactagaaaaggaagtacattaaacacaccttgttcatcttgaagagagagcaggggaatgggggtttcctcagcctgggatgactttcttctgcctttcagatctaagctctttctgacctggatcttatttaactgggaaacggccaggatagatttgatctttagcgtttctaacaaacatcatcagggatctctctttcctgaatcctatcacatttagcatcttgcaccacagtgctgagtatttttaaaaatataattttctcttttgttcttctgatgtttaatacattattcatcttcccaaatagattctcatttatctgggtgcaataagttcatctagagtccttccttacctactttccttcctttcttctttcatgcattccttcttccctccattagtaataggctgactctatactaagacttcaaaaatgtgcatgttctttaagagtttacagatgttctaaaactgactgtttcagaggaactactttccttgactcaataatagttaatcctcaagaacgattatgtatagtttttttaattcttcaactttgtgagatgtggttataaaacttaaattgatatagatgaaacagtttataaatagttttcacttgcattatttcttggaaagctcgtaaatactgtatgcaagtatcccctccattttctatgtgagcagcatgagcctgtattatatctacgaagtaaatgagtgggggtaggttttgtgacatgctggctgcatcagataatgctgcatggcataagctgggcacacactgctgttcctgttttatgcctaggaagatgaaagccttatcttaaatcataaaagtaattattaatgggcagcccaggtgggcagaccaggctgccaagtttactattttctatcgctctacaatgaatattccacattaggtatagattatctgttgtcaagagagttttatatcacactttgatataaaattaagtgtaaaaagctattgagaatcaatatttgacattctaaaagtaacttcaagatgataaagaataaatattatactaagcccaaaaatagtttctgggtttgttatattcatctgtttaataaatataagtggatgcgtggtgcaccaagaacttagcttggcattgaaaatgcaatgagaagtaactatgttctctactctccttgtggacaagagtctagtctgttaactagaaactacttctagatgattgggctgcaaatatgatccttctgctatgttttgcctagaactttaggcagaactttagttctaggcagaatgtagcagaagattatatatgcagcctgctcatcccctgaaatcaagcttaaagatgatggtctgccttgttagtaatccgtagaggcttatcaatcccagaaattttgggctattgttccagtctgtagatcactgacattcttttagtgctctttcaaccacaatttatagttcccaggatgggtcaacaactgtactcctgggatgtcttttctctctgtgtttgagatgcagatagctagttatccgccagtcctcacaatgctgaaatgcatccctcaagattaaagattctattcctaactttaaggaataaatctgagcttagtgcttcagtccaaatattttgtgaatacttagtatgtgctttactaggtgttatggatacagaaatgagtgtgaaatagtctctgacctggtagaactcaatttagacttaaacataatttggaaaataacacgtatggaggaagattcataagcctgatcatgtgtgttaggcataactagttaggcttataattatgcttaaatggattagatcaaccgtgtatgtaacagagctagtaaatagataattagatattaaaatgcaggtgtactgattccgaagccactaactcgtaatgcatctaccaaattcctctgagtgtaagattgttcattttagcagtttcagaactgtgtcactccaggacttaatctgtatggtaggggttctccaatttgagtgtgcacaggaatcatctggagagcttggtacaacaaagattgctcagtccttccctccccaggaactcactaggtctgagctggggatgaataatttgcatttatataaactcaggggtgaagctgaccatattttgagtagcactgaccttggggactgtttcccagacttcagcacatagtagagccatctggagagcctgttaaaagtggctgttaggacttccctggccctggagattcagaagggctgtgatggggctgaataatttttattttcaacaagctttcagatgatgctgatcctactggtccatggactgcactgagctaaggcattgtctaaataggtagacagaagtaacctactaagaaactcaattttgaaaaatatgaaggcttgatcaaaatatgtactctccttagcatggagtcctttcatcagagaaatgggaaaaagtaaaagtaggaaactaaatggcatgaatctcatgggcaattttaagaagcagtaggcactctaaatagcaactgactttgatatgtatggaggatgttttacatatattgggagaagattgtctgtctgaataatgtaactgtagaaagacccttagctttgtgtctatttagaggtcaatttcagtttctatccctctttttaaaaatatcttgtccgtgtattctgttcctaacattaacatataaggttgatagaaaatatggataatataaaaagtggtattgaatgatatcactagaaatagtgttcatgtaaagaaaagatatgggccagcaccaagttctgggcaactccacaattttgagaaattggaagagtggctggcaaataacaaacaggaaagtatggtgtcacaggagccaagaaaatgttctcgtgggaggcttcagcagtgaaaggattggaatgctgataagaaatactgtaagatgatggaagaattggctgtctaacttggctccatggagatcacgatatttctcattggaatgttttgctcaaccctaattgtccttctttgcagaatgaaagtcttgtgggaaaatagagattaaaatataactaattctgtctataaattatatagacatatataagaaatatataaattcaatctataaaatagaactaatgtgtttgtgtgcatgcaacatttttccgtgaaatatagttttgcttctgtatttttctgttcttattcatgccacacattattcattagcacagatttatattccattttgataactgatatccacagatattgttttcaaaattattattttatatgattatttttccatctaaattttaaaatcactttatcaattaagaaaaaagttttatttggattttcactggaattactttaaatttgcagattaatctaggaagaagggacatctttaccacattgaattttccttaacagggatttgaagattctctacatccttcaagtggtcctataaattctctaataacattttgtggttttccctctttgggcaataatactttctaaagacatttaatatattgttttgctattataaatgctgtttttatatgtttttattatagtactgttcattgacattaagtacatttgcgttgctgtgcaaccatcaccaccagccgtctctagaacttttttcatcttatcaaactgaaactgcataaccattaaaaagataacttcccattttttcctctcttcagcccctaacaactaccattctgccttctgtctctaagtatttgactactcgacgcacgtcgtttaagtggaatgatacagtatttgtccgtttgtgactggctttattccccttaacacagtgtttttaaagttcatctatgttgtagcaactgtcgggatttccttcattttcaaagctgcataatactcatacatacacacacaggcatacacacaacattttgttattcttttcatttaccaatgatcatctgggttgtttccaccttttggctattgtaaataatgcttctgtgaacagaggtgtacaaatatctgtttgcatcactgctttcaattgttttgggtatataaccagaagtggaattactattgattattaatgataatcctgttttactgttttgttagatatatcacaatatgaattcccagctacaattttggggtcattttaaatactctcagttttctcatgtaccattttcttgattttctttagtttgtcattacttttctttagctctcagagtgtatttaaggcagttgttttaaagtctttctctagtaaatctgaagccttgtttctttaaggttggtttccagagatttattttgatcttttgaaagggctggatttccctgtttctttatatgccttgtgatcttttgttgaaaattgggtgtctgaaaaatcagacacttcttccagtcactgtagactgtgtggaggaagatgttctctaaatagcccggtatgaaagtttaagattttctcaggcattttctaggtctgtgtcttccctgggcctgtgtgtgtggtgttctctcccaatttccccatagacggggctgcttttatttatttatttattttgaaggctgctttgaaatgttttattatccgtccctaagagtttcacccctgcttcttcgtgaaatcttggctgttcctctgtactactcttgccttaacaaacatcttgcccccagtttctgcatgtcagcatactcttgcagttttcacaaactatgttacccatcacagttttgcatggcttccaaactgagattcaaactatatattcattttcgtctgagagctccaattgaggcaagacagaaaccagtccctcaggcagcccacagacaggccagaactttgcaaaataagttccactgccctccttccttcctgagagaaaaatactggaaagtgggctacttttttttttttttttttttaactgcactcactgttccaaggtggcgcaagcacaagcaataatgccgtgaaatgtcctacctttttcactgtggctttttcttgatggggcattcacttggttggaaagcagtgaatttggctggttaccagagctcccaaaaagctgttttagtgagtcgctagtagtttacttgatgatcctgtggaggaatgaggacctggagctttctaatctgccatctttctgatatcaaatctgtttgtttgtattttgtcttttttagtagctttattgtagtttttaaccctaaatgtgtccagaatcacagttgcttagtcctgtcttagacctctaaatcgtgatgctaaaagtgtaaaactaacaccacacaatatattaaggatagctgtcatacttattttgtttctaatttactgttaattcatctaggagtgtgtatgagttcgttttgacattactataaataactatctgacactaggtaatttatgaagaaaagagtttaattgactcccagttccacaggcttaacaggaagtatgactggacggcctcagaaaacttaccatcatggtggaaggcaaaggggaagcaaatacatgttaccatggcggagcaggagagagagtgagtgaagggggaagtgccacacgcttttaaaccatcacgtcttgtgagaactcactcactatcatgagaagagcaagagggaaatctgccccccgtcatccaccaggccccttctccagttgatcccactaggccccttctccaccatgatattttggtagggccacaaatccaaaccatatccaagtgtgcaccaataatcgtaattattggggagtgataaatgtgaattgcaactcatataattgcgagttcttttataaacaaattaattgtaaaaaaacaaacccaagcttaggcaacatagcaagaccccatctctacacaaaatatatagaaaaaaagtagccaggtatagtggtacatttctgtggtcccagctacttgggaggctgaggtgggaggatcacatgagcccaggaggttgatactacagtgagccatgattgtgccagagcaggaccctatctcaaaaacaaaaacaagaaaaacaatcccggaacaaaataaataaaacaaacaaaaaagagcaacaaaagacacttgcttggcatttctaacaagcttccagctgatgttgatgcctttgtaccatagctcagattccagtatgatttagcatatttaaccttatgtaggtcaacagcataaacctataaagagtataattttgaaaaatgtgtaacttgtaataagttataaaaaaattactttactcagcatagagtcctctaatcatagaagaaggataaatgaggaaactgtgaatggcatgagagcaatgagcaattttaagaagcagtaggcggagtaagtattaagtgcaacttaaatataagaaataatctctatgattatattttctttattggtattcttaactgatgtcttgtaggaaaccatgactgtttctcctaatactagacaatagtccataatgtttgttatttatactaaactcttacattcaattgactaaagttgtctttagtataattacatttatttctttaaattgaatttgaattttctttttgtggtatttttttcagacatactattcagatgacacgaacttaataaaaatttagaatttttttctgccttcaatatgttataaaatattttaaatagtgcaaaagttatttgtttcttggaggcaaaaatcagattttgccttcttcttttggaaactccttgaaagttatctcagttccttttatgcttattaatctaatatagcttgtaaatgttgtcaattattttttccagaaggaaaagaaatgcacattttgtggacatttccaaatacctacatgtgtatttttatacacattctctacttttaaaaaaactcctctgattcctttttcattctagattttgtatagttacataatcccagcatatccagcaccttttttataggatgttgattgaatgtgcatagtgaatgttttatatcaatataagaaaattaataatttttttctttatttcccatagcaaaattttatgatttattcttttacctttattttttttaaccttgtattgtattattgcctagaaaattctttctcagactttatgctcactgggaacaggtcttattttaatttgtattcccagcttcatcttgtgtggtatcccaaaccttaacacactccagtacattttgttaaatggtaaatggtattatttaaggaaatttaaattgaatttctatatctcaaggcttttcaagccagagctggctaaacatttcttaggtgtgttgtaagagcatgtttctttaagatggagtttattccaggtatcttttaaagttttaactcttaaatgctgtttctttaatatcatgagacaatatagaaactcttaaaatattttaacttcctttaggatattttcggattattcagcataaatgtctttgaactatttcaaacctttccatatttgacattacttaccgttgaaaatataaacaccatcagtaaaataaaataactaaaagacagttcaaacttttgagctatttaacagaacgtgaactgatggaagaggagaccccattttttttttaattttgaggaactttattgaacttctttgagaaaacattaagattctatgtgaagatgtattgaagcaagtcaatatagggaagggataaaagaaagtgagtaaataagcttttgagtgattggtgtgattgggttaagaatgacgctaagaacgaacgtaaacagtgttcacactctagggctaaaaacccaagtacatcttttcacacggaaatacagatatttttaagaaccttccttgtgcttcttagaaagtagacaggtggttggagaaaatctatttttgttaaaacacacccacattcaatctagatgtataatttcaatatctcaatgatttttccttgtattttctctaaatgtcatgcttttcagactatttcaatatagatggattatatttcttttcagaatacatatggcagataaatacattgacgttttccaaaggaaagtacaaatggaatactatttcttaaaaaaacaaattttggtatcctttacttccttatgaagaaaagcaaatccgctggttaagattttttctttattttgccaaataaaatggtgtattacccttgcatttttcctacttattattcccagcatttttctccttgcacctaaacaaataaaaaatgaatttggacttagataaattatctttatagtggtaagccttgtctggtaaactaaactgttccctgaaggatgatgagtaatttgttgctggtagatgtaatgtaaatagttaggttacagactcagtttagtttggactatagcactaacgtgtctctaggcaatcacaatgtttaatatgatctgacgttgaacacaagcgtttcaactgatgcatccatccaccggggggctcatttacaaaagtagcaccatctatggatcatttaatgtttgcccctaagtttctagaccccctccttgtgatatcataatctaacatgcactttgttctgtgaccaaagcatccagatgaccatgttgcaagttcctaacatgttccttgtctaaggctgctgcccaggatcatacctgttctgttggtctggcatgtgcaattgattgctttcagatgttgggtggtagaaagccatcaaaaacaaagtcaatcaggatcactttcaccaccacttaattaactggctaattactttctaagcacctattaagagaacaagagattgttaactgacgtaaggaatctaaaattgtctaaggctgggtgtagtggcttatggttttaatcccagagctttgggagactgacacaggaggattgcttgaggccaggagtttgagatcagcctgggcaacatagaagacctcgtctttacaaaaaataattttaaaaaattaactgtgtgtgatggcactatgcctgtcatcctagctactcagaaggcataggcaggaagatgacttgagcccaggagtttgaggtttcagtgagctatgattgtgccatgggactccagcctgggtgacagagcaagaccctctctctaacaacatttttttaaattaaaaaaaaaataaaattttctaagatgtgattcttacattaaggagttaataactttaaacccaacagggatatgagggatctttatacatggttttaagcaacaccaacactaccattcaccatcatcattatgacgatgatgatgtcattcattcatgacataatgaatgatgagaaagagtacaagtatattgagggagaacattccaaacagttcacttagtgtaaactttcttatcatatacttaggtaagagttttttttatgagttattttattttaatccttccaacatttaaaaataattgtcattattattccagttgttcaggtaaaaattttgaggctcagaataatttagaagtgtgtttgcagtctcctagctctcaagtagcggagttggattcaaacttactggtacagtgtattttaggcacttttctttccagagaaaggaaagtcatatctggcttgcataactaggagaaattcccaagagaagagacatttgagcaggatgttgaatgactgacagtgtctataactggatgcatatgaaaggggttggatggaacagaattaggaatggaatggtgatgtgaaggttgaagcatctgaggcaaacgtaaggaaatggtaatcagagcagcatgaaatacaagattctttctcaaaagcagattgtgctggctggggaaacgggagcgtggatacagataattattcttctagactgacacatttgtgtttgattctttagccagtgtagggatgttaaagaactttggagaaaaaaagtaacgtaagtaacaccatgctttagaaatgtaatggtaatagaatataaggtggatggaaaggggagaattatattacattcattaagtcagcagttctcaaatagggacttgtatatgccttgagcattgatgagtcatttcagaggaaccacacattcttatgtgcatcactttatgaacagaaaaatatgtctcgctcaaatttgttttaccactttttaaatggtggacttccgtagccagctgtgacttggaaaatatacatttatttgcaaacattactgacttcaggatagcattactgaattccacatattactgtgaattttcccaaataaaaagtattgatgtacagttatgtatgggtccaaataacttattgatttattgattctttaatgtacttgttctagaaatatttatctttacaagtggcattatagtggttaagtgtgatctttataatcagattttatgaactagaactccagctctcctacttattagtgataaaaggatatgttactaatctcttcaaatcccgttttcttatctgcaaatttgtgaagatgacactaatcttaccagattattttgaggattatgtgagattgcaaatctaaaatatttcaataccagacacataataatatatataagctattattactctttgttagactatgtctggtagacattacatggttttatcatattcacaaactgaaaaacacagtcaaaagtcatttctcaaatggtttgtcatgagttggagtgacagcatatcaagatcataatcagtaaatttcagtttataattttttcttgattctcttactgaattgaaaagtcagttataattgctacatttctattctttttcctgttcttacattgtgaaacaataatatgtgcttgcttctgttagagttaataaataggaaagtatttatggttcttggcccagatacccattcgctgttggttactgccctttttttcactgtctcagttcttgagatgagtatttcccaactttcagaccactgtaggttttgatttacagcagcagcctctctcgttctgtcactctaccttctgagtagccttgaagtagggcatcattatagagaatcagcaatcatcacagcacacacattctaacaaagaaactcacctagaaacttgcaggaacgttgcattccagataagggtttatggtcacaaggcaactattgactgtctttatatcacttctctaaagctgataatttgggggacccactgtattgatttacgtggaaaatatgaatgagaatcctaaagtgcaagaggaatagaagtgttggataataagcattatttgaaaaagaggtgtggagcaagtcatttaagaaaaagtggaattgatctctcctggatttggtttatcagaatgaaagactaacttagagcgatttatctgagaagggaaacaacaaacaacaaaatgcctcctatgcatggtttcttcttgtatttatttagagtctagttctttaaatctgccgggtttatggcacaattcaataccaaaataactatatgaatattgacatcaatgttttaatctgtgagtcacaggaactcatgtacaaatttattaaatgttttctattctgtttatatttgttgacaacaaagcggctctacggcttctggtgtgatttgtgcacatgtagtgagctggatatcttcatattttgtttcatttatcaccaaatctgttagctatttctaaataaagaggctgtattgagaaaggatgaaaagcagttgggaaatggagtaggaagaaaaaaatgagaagctcagtgttttataaactgtattgcaaaaaaagctgactttcatttcaaatcattgtggtctgtgctttgctttggtgaattatgcccacacatatctagtcaacacaggagagcacagatcattggaggaatgaatagctttaccacatgcatcgtgagagatgtacaagtttattttccccatcaaccatacctttttccaatatcatgcatgttgcccagcaagacagtgtcattaaccactggtatagaaggactcatttaatttagttaactaaatcctgttttttttttttttttttttttatgagtggtgggagaactgtttaaaaaagacctgtttggttaacaaatgtgcgctgctctgcagtgagggacattttgaatgattttcccatttctagtctttgccccatccagttagaaagtagcccgtagtgcttcaagaacatttacatttacatctttattgtaggttccattgtagcaagaatacatgtaaatggactcgctctatttcaataattattttgcagagtattttggctatcatcctggtgtttatagtcaatgcatttttacaccatctacattttggacagcaagcataaaacgctgctggtttatctcacagagagagcagattgtcccccaaaagatagccatttataatatgtgcacttttgaataattaaatgaactactgaagaggaaatggattctaatcagctttcaaactgtgattgtgccatgcactgaatcattcctttatgaatacatttctcttggagcatgaataattacaaaacttttttttctatctcggtaggaactgggaagtaacagccctccacagagaaactggaagggaattgctattgctctgctggtgattttagttgtatgctcactcatcactatgtcagtcatcctcttaaccccaggtaatctgtctttattcctctcttatgatggatggtattgtggatgataatttcgcattcaaatgccttaagagggtagcaatatgtggtatcttagggcacattagcatgggttggaatttggaaaaaaagcataatcagacattttgcaaatggcacagtaattctgcagttcaaatatcatgcaggatattttggggaagctgaaaatgtaaaatatgtaagttgagaatgccaaggagatttttggtctccattgccacttacagacttactatgtgttagtttgataaatgcagaagacatttgacttttattgtgggttgaagatgagggagtggcatctggaagtttctatatatagatgataacccaactgtatggaaatggaaagacaggatttgatggaaaaagatcagatcgaaagagagtgatctaagcctctaaatttggacacctatttcttgtgtcttcttttcctttctttcctaaagtttttacattctaagtttctaccctatctaaagaaactttgcaaattgcccctgcaatgatttttggactgtgttcttcagattaaagagtttaatactaatatggaaattatcattgtgcttctttctggggactatttcaatacccaggagattcattactctttagtaggtactaataaggaaggcagagataaagggatcacttttaaactccttcagttgtcttccagatacatttagcagttgctgcaacccacccacccaactgtttttctcaaagaccaaacacccacatatgacacagtgttatgaaaaatagtcatttctgggataggattgaatgaatccaaaaatcaactgatatttttaaattatagcctgttgttgaatgctatttatttccacttcaggtttgtcttagttttgttattttatgagccccttaaacacattgaacttatttcctgatgtacaaaatatgattaacaataactgtttttcagagtcatttagtcaaataattttggtgactaattatacaaatggcagtatcaattgttccagtgagacacttcgtgagatataccatctttgaaaaatactgacattgaaataaataaactgccaaaaatgcagtttttagatgttagttaacatgtggagaggttgagaaagaaattaagggagctactagggaggaaggaggagagaaaggtaattggaaaggaagaaagaaaaaattccctggtaaaagttggcttatccggcattctccccaggaaccttttcttaactgcctcatttgtacatctgcagtacaatgtcattgagcaatgtgatggctctaagttgctgcataatgccaagaatcattgttacaggaagatgagtttcagcatggtgtttcacttaaacacaagaagtttaacataattataaaaaaagaatgagtcgacattgctgccttctattgatggctattagccagatggaggtattcatgtcataatccctgtgtatttctcttgaactctttttctttcatcctggttctagcatccttggcccagtgattcactttctcaggttttcttgttactcattgaggccatagtgatattttggtgtccttgagagtttgatacaacaaagaccacatagagtgaggcactcactaagttaaacttctgctcaacccttttcaatttttcccagtataaaaccacagtgatgaaccataattgagttcattttgtcctgcacttattcatttgttaaagcaagaacaagcgtgacatacctgagtttgagttctgcctctgtaatacagtagttttgtgcaatttggcaagttatttaaccttctctctcactttactcatctgcatgatgggtataatatttagttccaacattgcagtgttattatggaggtaaaatgagataatgtagttcaagagtttatttagcatgctgcctagcactgctgctgctattcctttgatgattgctattattcagtacttattgaccaccagaaaccatgacaagcagtgttatataaagaatgttccccagaaaaggtataaaacctctcaggaatatacatcttctgtgacttcaattttagttatgacaaacggaaagggacaaaatatttaacctgaagttagtctcctggggtcaaattattcatgcattcattcatcccataggtaattgtggagttctcaccacattctaggtgctgttgtagttggccctgcactttcgctattttataactttcacctccaatcccgttacacaaatacaaacatttagaaaatacacatatttagaacaccacagccccccaactcagacttaatttcatatgatattaatcatataaatagaagtggcatttatttatttatttatgttttgttttaagatggggtctcgctctgttgctcaggctggactgcagtggtgcaatcatggctcactgcagtcttgaacttccgggctcaagcgatcctcccacctcagcctcctgagtagctgggaccaccatgcctggttatgttttattcttattgttatagagatagggtctctctgtgttgtccaggctggtctcgaactcctggtctcaagcagttctcttgcctaggcctcccaaagtgctgggattacaatcataagccaccacacccagcccacaattattatttagatttacagtttaccaagtgcatttcacatactacatgttcaaatgtctttggatttcactattattattggtagggacattataaaataaaaaagaaaataataatgctggagtggaaaaggtattgctgtaggaagcagacaccctactttatacagagagtgttctatactttctgcaaactcaatgccctcaagtgcctagaagattatgtaaattgatcaagtgggcaagtataacaactagtggttagaaatttgagttgtgacccagcaaaatggcagtgtagtcgcatggcctttacggtgggctcaacccaaacatgtcagagtaatacataaggccagaagactaatagtttgcagctcaagacttgagtcttcagcctggaagaacttttagaaatgatctagtcttgcctctctcatcagacaggaagaatatctgagtttgtttaacttttggggtgagaacaagaatatccatcaaggccatgtacactcttgattttgcgtgtgtctggctgtgtacgtctgtggtcagcctgcagtgctccaactgcaccaagcctttctcttctaaccctcaggcttgagttctctcagctgtgctaaaacagagccataaagaaaacctccagctggaaattaaacatgcagcatcatccctctgatcttccctctgtccaccaatatgttctcaaggcctagctttctaagtaaaaccagtcaagcaggtggaaactttcaaccaagtagaggaatctatgtcaggaggggaagcttctgactgtggaaattcagcaagacactgggccttttaggacaaggcctgcctctagaacaactcttccaataagagtggcagtcaggccggacgcgatggctcacacctataatcccagcactttgggaggccgaggtgggaggatcacgaggtctggagttcgagaccatcctggccaacatggtgaaaccccatatctactaaaaatacaaaaaatgagccgggcatggtggcatgcacctgtagtcccagctactcgggaggctgaggcaggagaattgcttgaacctgggagtcagaggttgcagtgagcccagatcgcaccactgcacttcagcctggtgacagaacgagactctgtctcaaaaaataaaaaagagtggcagtcataaattcatatagcttttataattatacaaccctgggctagtcactaacttctatggcttcagtgtttcattgaagaaaaggacatctttggtttgctaaaatgtgaggtgatctcttgaagtgtattataactctaatgtctattatctaatatattaataacagctaccaatgataataatgccttgtttagtgacaaatatagcaacagatgaaatatggtgggctctttcactaagatttttctaccatgaaaatatatttagtgggttggttttgaagatgaaagcatacaaaaagttatttagtcaaagaaatgttttagaaactgttttactcaaaatagcacacaatttgcaggtaagtctaaggaatgcaagcctataaccagagaaacacatgttcactgtaatttcggtttgattgcaaattttattacagaagtagtttgacacatgtgccttaatttctaaaattatcagactcttccttgccttgtgaagagaagtcctaactatttttgaagaataggctattcaagcatttcattttataagtatttctgaaaggaacaaattattcattccatttttttaattacagggtggacttattcagatgcattgatgaagcctacattattttttctattgagtttgtttaaagagaaggagtttacccacgtttattttgagaatatgttaactataagatcaataattatactctacaaatatatgagtgtacattaatgcttaaagttgtagaaatcagtctagtaaaggtatgcatctactttgcaatcttgtttttacatttaatatgtagaatgagaaggaatatacttgggagaacattttgtgcagaatagaattaccaattttggcctgttttaagaacaaaggtgcatattttatgagtcagaatgcagttgatacaggatagtcatcaggctctttaatccatctgccatactgaaatagccacctgcgaactgtgtatactccacagttcttcagcaacaatggcctgttgccctttgactgtgtctgtaatcggtcaatgccgagacagagtcatcacactgattatctgtcatgctgactaagggtaaaacgggaaagcaccaaaatgtggtcttcattgttagctctagctcctgtttcttttggaaacttcccaattaccctctgttacaatagtgggattcattcctttagtacactttttaggtgtgcacagtagatggtctttgcaggtttatcagaatataaacataaccaagcattgatgtgggaatcatgagagctctgcttgatctcagttaaacaagaatttaatggtaatttttcagttccgcaatagagatgtctttattttcacttctagaagtgtctctaagattaagaattttaaactaatttcataggccatgttgggtaataacttacccaggtcgatactgccacagtgatgttgatgattagataagtctttaatatcagatatgtgttacatccatgaagctatgctcaattagttcatttgagtcaaaacagagaattaagcaagtgaaggaaactagagaaacataggcagccctattcagaaaaatcaacaaaagaaaccaaaaactagaagacagcatttaaggtattatgccttttttacatcaacctaaatgtacagtgcacacaatcaactcatttaaccctcataacacaccagtttaaaggaagtagagcagttttctacataacacagctagggccaatagatttggatgacttcagcagctagtttgtggagaaagtatagtagatagagtgactaaattgaccttggtattcgactgacttggattcatctcctagccttactatgtgcccacaaatatgatgttgaggtaaagaatcctctctgttcctattgttaagacaacagattaaaaaaaaaagatttgaccctttgaaagagggctttaaaaatattcatatgcctgcacacacacacatgcacacacacacatacacacacacacacacacatacatctatatgtaaaactcatttcctagaaagcatttaataaaattaaggactttattggactgatgacagctgatctgttattgttatgcaaaaactcaaagtgaattcattctagttactattttgctctaacaaaatgacagctcctggttatagttagttaaaatgttatgttgtactatattgcagacaatatcttggcatctgtaatttattaggtgtcatttaagcacctgacctgtgttttaaaatgtcaaagcaatgattaaactatccccattatgcattatgaggggaaaataatgttttaccagatttttagatttgtactacttgtaaacatcggcatcaatcaagatgcaaattgtttattttgttgaattaaagcaggagatgtgctgtattgataggcatagtctaatgtgtctctgcttgtttttttcaacaacagcacagattgaacatggatttccatgtagcattacccaggcataatcaggctgcagagaaaacaatgacagattctaacagtttccccctggataatatggattgttgttgcttttttaaatagatttatctctgatgttgaataaaaaataatttcctctggcattaacggaataaaaacagttacttttttgtctttcctttatagtttcatttctatatttaagccatatgtgattcccttagttactctcataatgttagagtgtccagtcagataaatgatgaatttggtttacattataatgtgtttagttttacaagagtcagaagagaacctataaacatttatgtatatctttttcttgccagatgttgtactaagtgctttacatgtactattttttctcacatcactaatattgcatagatactattcatttatttacattctagagtattcatctgagtcttacaagttgaagtaaattgactaatttcacacaactagaaggcagagatgctcgatcactctctcaggcacttttagctttgacatgtgtcataatccttgtaatataagttaagacatattcttgtgcccatggatgataggggcaaaaaaatattttagaaaaataaatttcccctttattctttcctatgatttttgtaattagtaaactaattctatgtatttctaaaagggaaggcatagcagagaaagaattcagctgaggattgaggtgtaaaaatttggacaaggggcagaaagggaggcagtgacagaagtgggaagttgaaaatcgtaagtgtaaattctgtatgtatttttatttctggtttcataatttttcagaacttcaaatacccatgataaaatataagttcatattttccatcctaaaccacattatataaaattgtgtgtcattatacaactttaatagtttgtcatatattttatttcttcttcctaatagaaatttgatttagaaatgtgatattctggcctctaatgtatgattagatagtctggtctctgagaagtcaggtttccataaaagcgagagttatggtggggtttggtggctcatgcctgtaatcccagcacttgaggaggccaaggcaggaggatcacttgagcctaggaattcaaaaccatcctgggccacatagtgagaccccatcgcaactaaaagttttttaaaacaattagccaggtttgttggcacatgctactcaggaggcaggaggattgcttgagacggagaagttgaggctgtagtgagccatgatcatgccactgcactccaagctgggcaagagagcatgactctgtccaaaacagtcttccatctagttccaaaacatattcatcaccccaaaaggaaactctacccattaagcagttgctcctcatatcccacctcagttgctcctcatatcccacctccctcatcccctggcaatcaccaatctacttctgttctctgaagatctactttttctagatatttcacataaatggaatcaaataacatgtgacctttagtgtctaacatctttcactttgcatgttttagaagttcatccaccaagtcacttgtaacagtgcttcatccctttttatggctcatagcaatccattgtatgcatattccagagattgtgctactgtgaacctgtgtgtatttgtttgagtccatgtttttagtgtttggggttatatacctaggaatggaattgctagatcctatggtaatttctgtgtttaaatgtctgaagaactatttgccacagcagctgaaccatcttacattcccaacagaaatattcatgtgttccagtttctccaaattcttagaaacacttgttcttttcttttttttttttttcaattatgggcattcaagagatatgaagtagtatctcatttggttttaatttgcatttccctaataattaactatgttgactgagtatcttcttatgtgtctattggccatttatatatcttctttaaagatagatctatttaagcctgttgcccattttaagggacttgctggttttactgatagtgagttgtaggagttctttattccggatattaatctcttgtcagaaacatattttcatatactttcttctataatgtaggttgtctctttactttcataatagtttcatttggtgcacaaagttcttcattcacctgttctttcattgcttgtgcttctgatgtcttatttaagaatacactgctgaatccaaggtcacaaagatctgtcttttgttttttttaaatgagtttatggttttagtttatctacatgggtcattgattcattttgagttaattttttttatggtgtgagttagggagtctagctttaatttttgcatgtgaataaccatttcacccagcaccatttattgaagagaccattctttcccaattattattgtgtgaaccttccttggttatagatatatgagttatttctgggcttataattttacttcattcatctctatatctgtcctcatgctggtactgcattgtttggattactgcacctttgtggaatgtttgaaatctggaagtgtgactattacactttaaaaatatatatattgctttgctatgaagagcccatcacagttccatataaatttgagaattagcttttttatttctgcaagaaagccagttgggattttaatagtaattgcattgagtctgtatttgctttaggtaatattaccatcttagaaatattagtgttccaactcataaatatggaatgtcttttcattctggaaataatttaaataaaacaaaaatcaacattttgtagtttatagtgtaaaagtttttcatacttggttaaattcatttctatttagtttattcttctttatgatactgtaaatagaaccttaatattcttttctgattaatcattgttggtatacagaaacatgactgattgtttagtgttgaccttgtactcttcaactttgttgaaatcatctattagctttagtagcttattgtagattatctgagattttctatgtatgaggatcatgtcatgtgtgaacagagatagttttacttcttcatgtccaaattgaccatcttttagttctttttcttgtctagttactctggctagaatttccagtacaatgctggataacaatggtaaaagtggatattctcgtcttattccatcataggtggaaagctttcagtctttattcattgagtagtcttagcttgtttagataaagattctttacattgttgagggagattctttttatttctagctcttaaaatatttttataaggagtgttggatattgtcaaatagattttatcaataaattgagatgatcatttgttttcctcccttttctactatatgttgtattacattgattttcttttgctgagccactcttatattcctggaataaaacccacttgttcatgatgtataagcctcttcatatgctgaagaactcagttttctaatatacctgaaggatttttacatctgtatttataagagatattgatctgttggtttcttttcttgtgctatctttgtctaggtttcatatcaaaataatttttaacctcacagaatgagatagtaatcttttcttgtacagttttgggaggagtttgagaaagatgagtgttaattcttctaaatgttagaattcacaagtgaagtcatctggttctagcctttctattgttaggaaggtttttgattaatgattttgtaacttactcattataggtctgttcaggcattttatttcttcttgaataagtttggtagtttgcgtttttctagaaacttgtttacatcatataatgtcttagttcatttgtgctgctatagcaaaataccacagactgggtaatataaacaatagtaaattatttctcacagttctgcaagctggagaaagtccaagatcaaggttctagcaggactggtgtctggagagggctgctctctgcttccaagatgatacctttttgctgcactctccagagggaaggaacactgcattctcacatggcagaaggaacagaaggaaaagacagccttcccttcaatcctaagctcttttataagggtattaatttcattcgtaatggtagggccctaataattacctctcaaagttcacacttctcagtattattgctttggggattaaatttcaatatgaatttggaaggggaatataatcattcaaaccatagcatataatttgtatctgtattgtttgatacatatatgtttattattttgtctctttaatgaccatttttcaatatatagtatcacttcttctcataacaatttttgacttaaagtctaatttttctgatatgaggataacaaattctgctctttcttgattacagtttgcaaagaatatatttttccatcatttaccctcaatgcattgcatctttagaaagcaagtaagtgaattttaaaaatccattctgccattttcagccttttgaatggagaattacatttatttacatttaatttcttaaaatgaagtaattgtttcattgttccatttgttttctgtttgtccttttacgtgttttttttctttaagtccttcaatgctgctttcttttgtgtttatttttataatgcccttctttgatctcttctcatttcctctcgaattttttttcttatggttatgttggtcatcataattcatattttaaatttagaacaatttagtttgaactaattttatcttatgttcaatcacatacacaaactgtttttatacagcttcacccttacaatattgtttttgtcacaaattacatctatatatattgtgtgaccattaatctagatttataattattattatacatttttcttttaaatcatgttaatataagaaatataaagatgagtcacaagccaaatatacaataagactgccttttctatctacctagggagttatcattactagagttttttgtttcttcatatagcttcaaattattgcctatatttttccacttcatgctgaagcctccctttgacatttttggagggcagttctacttattgcaaactccctcagctttcctcagcttttgtttatcagggaatatcttggtttctccttcatttgagtgacgattttgctatatatagaatttttggttgaaagctctgttcttggctgggagcagtggttcacacctgtaatcccagcactttgggaggctgaggtgggaggatcacctgaggccaggagtttgagaccagcctggccaacatggcaaaaccctgtctctgctaaaaatacaaaaaattagctgggtctggtggtgggagcctgtaatccccgctccttgggagcctgaggcaggagaatcacttgaacccaggaggcagaggctgcagtgagctaaggtggcgccattgcactccagcctgggcaacaagagtgaaaccccatctcaaaagaaagaaagaaaggaagctcttttctttaaaaatgttgttccaccttcttcttgtctctatatttattgctgagaaatctcctgttaaacttattgagaatcccttatatatatcaagagggttttctttcgctgcttgcaggatcctatctttgttcttatcttctgcgtattttattataatgtgtctcagaatgcatttttttagtgttttttttttttttttgagtttgttgaacttcttgaacatatagttctatgtcctttgccaaatttggcaagttgttggccgtcatttgtttaaatactctttctgcccttttcctctctctcctcttgtgatttccattattttatgttgctatgtttgatgatgttttaaatgtgtcttaggctttgctcattttccttcactcttttttctttctgctttctgtaccagtaattttaattgatctattattattttcactggttctttcttctgcctgctcaaatctgctgttttattcttctactgagtttgtatgtaagttcttagacttttaagctccagaatttctgtgcatgtatgtgtttaatactttttatctctttattgatattttctacttttttcatacattgttattctggtttcctttagctctttattcatgatttccttcagctctgtgagcatatttaacacaattgatttaaagtcattctctattgagtaaaatgtctgtgcctccccagcagcagtttctattaacatctgtgaatggacttcactttcttatttctttggatgctttacaatttctgattgaaaagtgtacatcttgaatattacagtttggaactcttataatcaaatttttcttccttttctgggtgggcttttgtttcttgctgtaggctgtagctatttgtgttttctttggtagaatattttaaactatttttgaaaaatcactattattcaccatgtatgttctctgaagtctctgttctttaggttgtggttagctagggttttctgtttgattattctgttttccttaatattttggtttagaaatgttttcttgaatattaggaggcaaatgtggctatggtggggtgtggaggctaggagaaataaaaaacagagagggtaaaataccttttcaggttagctctgtgtttcacacttaaacacttagccagcccatttacaactctaccttaatctttacttcctgcctctcttattgtgataaacctggattccttattatagttgaagcccagcataaggtttatatctttaccacctacactgctttctactttattatatgattcataatagtttctattacaaactaagttctcaataaatgcaggcatgcattgtaatattgcaggtttagtttcagaacactgcagttaaacaactattccaataaagcaaatcatacaatttttttttggtttcccactgcatgtaaaagttatgtttatcgtatttgtagtttattaagtgtgcaatcgcattatgtattataaaaatgaacagaccttaaataaaaactgctttattgttaaaaaaattctatttgatgatctgagccttctgcaaatcataatctttttgtcagtagagggtctttccttgatgttgatgactgctaactgaacaagctagtggttgctgaaggtgggtgtggctgtgacagtttcttaaaataagagagaaataaagtttgccacattaactggcaattcctttcacaaaattttatccatagcatgcactgctgtttgagagcattttctccacaatagaccttctttcaaaatgggagtttcttctctcaaatcctacttctttatcaactaagtttatgtaatattcgaaatcctttgttgtcacgtcaacagtgtttacagcatgttagctaggagtagattccatgtcaagaaactgctcctttcacttcatccataagaaaaaactcctcgttcattcaagatttattttgagattgcagcagttcagtttcatcttcatgttccacttttaattcaaattctcttgctgcccctaccacatctgcagttatttcctgcactgaagtcttgaacctctcaaagttatcagtactgattggaatcagcttcttccaaactcctgttaatgttgatattttgaccttttcacataaatcacaaatgttcttaatggcatctagaaatgtgaattatttccagaagatttttaattcactttgcccagacccttcagaagaatcagtatctatggcagccttatcaaatgtaattcttaattaccaacattggaaaatcaaaattactccttgatccgtaggctgcagaatggatgttgtgttagcaggcatgaaaacaaccattaatattgatgtacatcttcatcagggctcttgggtaaccaggtgtattgtcaatgagcagtgatattttaaaaggaatatttttatgagtagtaagtctcagtagtggatttaaaatatttagtaaaccatgctgtatccaagtgttgtcagccaggctttgttgtttcatttataaagcacaagctgagtagctttagcatgattcttaagggccctagggttctgaggatagtaaatgagccttggcttccacagaatgtcaccagctgcattagcccctaataggagagtcagcctctcctttgaagctttgaaaccaggcattgacttttcctctctagctatgaaagtcctagatagatcaagaccatgctggctaacacgatgagaatccatctctactaaaaatacaaaaattaggcaggcagggtgtcacgtgcctatagtcccagctactcgggaggctgaggcaggagaatcacttgaacccaggaggtggaggttgcagtgagctgagatcgcaccattacactccagcctgggtgacagagcgacactccgtctcaaaaaaaggaaagttctagatagtatcttcttacaataaaaagctgttttgtctacattgaaaatctctcgtttagcatagccaccttcatcaacgatcctagctacatcttcttgataactggctgtagtttctacatgagcacttgctgcttcaccttgcactttgatattatggaaatagggtctttccttaaacctcatgaaccaatctctcttagtttcaaagttttcttctgtagccttctcatctctctcagccttcacagaattgaagagagttaggaccttactctagattaggctttggcttaagggaaaggtgtggctagtttgatcttctatccagaacacaaaaactttctttatatcaacaataagcctgttttgtttttctatcatttgtatgttcaatagattagcacttttaatttcccataagaactttttgtggctaactgttgggagcaagaggcttagctttcagcctacctaagcttttgatgtgccttcttcactaagcttaattgtttttagttttggatttaaagtgacagacatttgactcttcctttcgctggaatacttagaggctactgttgccctaatttcaatattgttatgtcttagggaataagggggcctgaagagagagagagagacaggggatcaattggttgatgtcacggttagaacacgcacaacattatgctcttatgtggtcatggttcatggctccccaagacaactacaatagtggcatcaaagatccctgatcacagatcaccgtaacagatataataataataaagtatgaaaaattgtgagaattaccgaagtttgacacagagacatgaagtgactgcatgctatcagaaaaatggtgtcaataggcttgcttgacaacaggctaccacaacccttcaagttgtaaaaaacaatgtctgcaaagtgtaattgagcaaagcacaataaaatgagtatgcttgtattgaccagtgacaaatttatctggttatccactcttgcaataaaaatgtcagagaattgtttagtgaaagttcttgataatgaagtaataaataataatacaatagaataaggttattaaagctgatgatattaccaaatagaaaagaaagtcaacatcttttgagacttgaataatatttattataaccctggcagtttgaaatgtggaaaaacataaacttgtaaaatacacaataaagtacgttcagtagaacttagtgtagtgtactctaacaaagtattgaggacccaaaaatgctttggggcatttgaattgcatatatcaccatttgtaaaattagacattgcaaataaattctgagatttcaaataaaatgtgtattaatttatttaagatgacaataataaaacaattacatataaatataaataacaaaatgaaaagttatgtttttcaaaacaaaaaaagcaaaataaatggtattgtttcacatttttacaaatgtatttaatgtctaactcagaggaagatggcagaattctcatatgtgctcctctgttaattcttttgcaatacattgttttggttgagatatatgcagaaattctgacctgataaagacacatagtcagaaatagaatatgtatgttaatagctatttcagatcattgtagaggttttttgctgttacttcctgaaaactagataagtgctagatgcttgaaggttaattgcagtgtaaaatctgaataatattttaatactctgctacattaaagtccattggtccatcttacatgttgaaagactcttacccacgtctacttctgtaatatgaattggtcatttgtaaaatattagttcattgagttatgcaggtcttccaaatgtcagtggagtttattatacagccatgcacattataatggcttttaggtcaatgacagacttcatatatattggtggtcccatttgattgtaattcagctgtaaagttcttatcccctagtgacacaaccgtagtaaggtcatagtagcatgattcattactctggtgtttttggtgatgctggcataagtaaacctactgtgttgcctgtcctgtaaaattatatcacatagaattacatatggtacataataataatgataatagactactacattactggattatgtatttaatatactacacttttattattttacagtgcattccttctacctattaaaacataagttaactgtataatagcctcacgaatgttcttcaggaggtattccagaagaaggcatggttatcataggagattttagccccatgcaccttatttaccctgaagaccttctagtggaataggatatgaaggtggaagacagtgatattgatgatactgaccctgtgtaggcctaggctaatatgtgtgtgtttatgtctttgttttttaaaaataaaaatattaaaatagacaaaggttatgcaataaggacataaagaaggaaaatatttgtgttcagttgtcaaatgtgtttttaagctaagtgttattagaaaagtgtcaatgatgaaaaacattgataaagtaaagcagttacaggaagctaaggttaatctactactaaagaaagaaaattttttaatgcatttaatgtagactgtgcagtgcttataaagtctacagtagtgtgcagtaatatcttaggcattcatattcactcaccactcacttactgactcactcagagtaacttccaatcctacaagctccattcttgaagtgccctatccaggtgtaccattctttttatcatttataatgttttttaactatatattttctatgtttagatacacaaatagttaccattatgtttcaattgcctgtgattttcagtgcactaacaggcagtacaggtttgcagcctagcagtaataggctgtatcttatagcatagatatgcagtagactttagcatctgggtttgtgtaagtacattctacgatgtctgcacaaccatgaagttgcctaatagcacattcctcagaacatatccctgtcatttagtgacatgtgattgtacagttgttaaaaatcatgatgaatttcactaatgatttcactaggaaaagctcactagagaattattgagaaatgatcaaacttaagatggagaatatcagttttctaaaattcattttcttgcttgaaggggctcgaatttttttgtttgtaacaaatacagccaattgtggattttgtgaagaaaaagtttacttcattttgaagaaaaacacctgtcagacacttaaatctgaataattgtagtttgttactcattccttccagtaaaaataatgttctatgagaaacaatgtggtgagtttagctcataactcaagcaactgaccatatgcttttccatgagataaccatcatatttcgtatgcactggtgttattttattttttgacatactgcaccacacagatattcaaaagatgttgagagtcaagatgtagtacaattaatattttttactacttctgaactgaaactgggtttatttttaaattgaggctatatggccataaagaatataatgacaattgtttgatgtcacagtgtcgacttatgaaagggtgcctggagttttatcaaccattgcttttgtatcacaagtgaaaatttcaacccattgacaaggacaataatgtcttcgtgttattatgaatacagttttgatttctgtgacccctgtcttcctgaagtccacaaccatacaccagaaacctctggtgtaggctaataaagacatgcaataaaaatttggtcatggtaatgtgatagaatcaagcaacatatgtgaaggaggaacttaaatatgactttatagagccataacactttagggtaaaaggaggacatcatttcagggtgtatgtgtgtacacatgtgtatgtatcacagtgtgtaaatgctcttctccaaatgtggaaagcttacatacatttctcatatttagattctttactcatattcaggagatgttaatttgaaaaaggtctcagaaagaggtttgagaatcattagcattttgaatgattgactaatttggctaattagaactatgagtaaatcctaaagctcttgacttatgtaatcaatggatgataagtttgaggtaaaatttaataatagtccttcagaacctaaaggtacatttcttatttgatgagcactttgagtcactgccaaaaatgaaagagcctagtataagatataccagaaatttgagaatcctaagagatgcaagctagtttgcagctcatcatgtgtgtttgtatgggttttgtgtgtgtgcaagcatgtatgtgtagagcttcaaataaaattctatacaaagaatcaaacatgccaaagcagcatttttctggttgaagaggtctaatcacataacctctgtccttccctcatctcttctctatcctgaaagagttcactagagtccttagaacactgctggatatagtgtgatttagtccaactcttggtctttgcaaatgcaaaaaatgatgcataaataaatggagtgatctaaccaaagagatacctgctagtgaagggttgaattaggactaaaatatgaccttctaactctgatcactgtttgtgaagcatcattgcccatccccttttgagaacagagaagcagaggttagatttattacagtatgctgggcactgcagggaaggtgaaggcattgtaggtggtaaacttcttgcagattatgcttttgttttatgtactcagtatgaatatcctaaatattatttctatatttgttgaaaaaagagcagagttttgtgagaaaacagaaagaagcagataataaattatatttcatttgtcagctgtcctcctcattctatttaatacaggcacagtttggtcttaatttagttacttaccctatgttgagttttaaaaatgtatttataattaaaatatggctttctgtatgaaagtcccattttggaaatatactcagataggaaagaacattcattggatgattgtctgacccaggaaacaaattaaattaaggagtatgtattattaggctttgtaagatacagggataatctgagtcaaaagtagttcttgctttctttattttttattttatttaagttctagggtacatgtgcaaaacgtgcgggtttgttacatatgtatacatgtgccatgttggtgtgctgcacccattaactcatcatttacattaggtatatctcctaatgctatccctccccgctccccctacccaatgacaggccctggtgtgtgatgttccccttcctgtgtccaagcgttttcattgttcaattcccacctatgagtgagaacatgaggtgtttggttttttgtctttgcgacagtttgctgagaatgatggtttccagcttcttccatgtccctacaaaggatatgaactcatccttttttatggctgcatagtattccatggtgtatatgtaccacattttcttaatccagtctatcattgatggacatttgggttggttccaagtctttgctattgtgaatagtgctgcagtaaacatatgtgtgcattgtgtctttatagcagcatgatttataatcctttgggtatgtacccagtaatgggatcactgggtcaaatggtatttctagttctagatccttgaggaatcgccacactgtctgccataatggttgaactagtttgcagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcttttgcccactttttgttgggtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattgtggcttttgttgccattgcttttggtgttttagacatgaagtccttgcccatgcctatgtactgaatggtattgcctaggttttcttctagggtttttatggttttaactctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggtactatttctgttctgttccattggtctatatctctgttttggtacgagtaccatgctgttttggttactgtagccttgtagtatagtttgaagtctggtagcatgatgcctccagctttgttcttttggcttaggattgtcttggcaatgtgggctcttttttggttccatatgaactttaaggtagttttttccaattctgtgaagaaagtcattggtaacttgatggggatggcattgaatctataaattaccttgggcagtatggccattttcacgatattgattcttcctatccatgggcatggaacgttcttccatttttttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttatttgtgtataagaatgcttgtgatttttgcacactgattttatatcctgagattttgctgaagttgcttatcagcttaaggagattttgggctgagacgatggggttttctaaatatacaatgatgtcatctgcaaacaaggacaatttgacttcctcttttcctaactgaataccctttatttcttcctcctgcctgattgccctggccagaacttccagcactatgttgaataggagtggtgaaagggggcatccccgtcttgtgccagttttcaaagggaatgctcccagtttttgcccattcagtatgatattggctgtgggtttgtcatagatagctcttattattttgagatatgtcccatcaataccgaatttattgagagtttttagcctgaagtgctgttgaattttgtcaaaggccttttctgcatctattgagataatcatatggtttttgtctttggttctatttatatgatggattatgtttgttgatttgcatatgttgaaccagtcttgcatcctagggatgaagcccacttgatcatggtggataagctttttgatgtgctgctggattcggtttgccagtattttattgaggatttttgcatcaatgttcatcagggatattggtctaaaattctcttttttttgttgtgtctctgccaggctttggtatcaggatgatgctggcctcataaagtgagttagggaggattctctctttttctgttgattggaatagtttcagagggaatggtaccagcttctccttgtacgtctggtagaattcagctgtgaatccatctggtcctggactttttttggttggtaagctattgattattgcctcaatttcagagcctcttattggtctattcagagattcaacttcttcctggtttagtcttgggagggtgtgtgtgtccaggaatttatccatttcttctagattttctagtttatttgcatagaggtgtttatagtattctctgatggtagtttgtatttctgtgggatcagtggtaatatcccctttatcattttttattgtgcgtattttattcttctctctttacttctttattagttttgctagtggtctatcaattttgttgatcttttcgaaaaaccagctcctggattcattgactttttgaagggttttttatatctctgtctccttcagttctgctctgatcttagttatttcttgccgtctgctagcttttgaatgtgtttgcttttgcttctctagttcttttaattgtgttgttagggtgtctattttagatctttccttctttctcttgtgggcatttagtgctatgaatttcccgctacacactgctttaaatgtgtcccagagattctggtatgttgtgtgtttgttctcattggtttcaaagaacatctttatttctgccttcattttgttatgtacccagtagtcattcaggagcaggttgttcagtttccatgtagttgagcagttttgagtgagtttcttaatcctgagttccagtttgattgcgctgtggtctgagagacagttttttataatttctgttcttttacatttgctgaggagagcattccttccaagtatgtggtcaattttggaatcggtgtggtgtggtgctgaaaaaatgtatattctgttgatttgggtggagagttctgtagatgtctattaggtccacttggtgcagtgctgcgttcaattcctggatgtcctttttaactttctgtctcgttgatctgcctaatgttgacagtggggtgttaaagtttcccattaatattgtgtgggagtctaagtctctttgtagatctctaaggacttgctttatgaatctgggtgctcgtgtattgggtgcatatatatttaggattgttagcttttcttgttgaattgatccctttaccattacgtaatggccttctttgtctcttttgatctttgttggtttaaagtctgttttatcagacactaggattacaacccctgcctgtttttgttttccatttgcttggtagatcttcctccatcccttcattttgagcctatgtgtgtctctgcatgtgagatgcgtctcctgaatacagtacactgatgtgtcttgtctctttatccaatttgccagtctgtgtcttttaattggagcatttggcccatttacatttaaggttaatattgttatgtgtgaatttgatcctgtcagtatgatgttagctggttattttgctcgttagttgatgcagtgtcttcctagcatcaatggtctttacaatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttggtttggctggatataaaattctgggttgaaaattcttttctttaggaatgttgaatattggcccccactctcttctggcttatagggtttctgccgagagatccgctgttagtctgatgggcttccctttgtggataacccgacctttctctctggctgcccttaacattttttccttcacttcaactttggtgtatctgacaattatgtgtcttagagttgctcttctcaaggtgagaagagaagtttagggaaaaaaagagtaaaaagaaacaaagaaagcctccaagaaatatgggactatgtgaaaagatcaaatctacctctgattggtgtacttgaaagtgacggggcgaatggaaccaagttggaaaacactctgcaggatattatccgggagaacttccccaacctagcaaggcaggctaacattcaaattcaggaaatacagagaatgccacacagatactcctcaggaagagcaactccaaaagtaattctaattagtagaatttatcaggaatggaccagagcagactctgttttttttttttttttaagaaacctagctatttctgcaacaagagattagaaagagtaagaaaaggcaaaagaaagatatatagaaggaaatccctagtatgccaagaagagcaaaggtgattccctggaactgtaaaacagatgtagtgtatttgacttttcctttttggcttttgcttgaatggatgaattaggcttcacaatactaagtgacaagctattaggttttcttcattaaagagcttgaactatagattattatttttccaatttatattttggaacttataaagtcaacatagttaaatacacttctgaaaagagacttttctgtgaattttacattttactatatttttccaataactataaagaagcaacttcatattgtgtttctaaaagtaaatctgagaatacacgtagaaacatttcggttgaagagaacaactatgaaagagatatttcaagagaatgaaaaatattttttgtttgtctgaaagtgaataatgtgaaggtgctttatagggccctgtatattttacattttaataataataaagacaatagctaaaagtaaatgagctccgtaatttgcttggtgatttctatataagtcttcttttatgtaaaacacaaaacaaaacataacccaaaaaatctatgcaaaatataccaggatatatctttttttttttttggttctactactgtattagttcattttcacgctgctgataaagatatacccgagactgggatatttacaaaagacgaggttttattggacttacagttctgtatggctggggaggcttcacaatcatggtggaagaaaaggaggagaaagtcacatcttacggggatggcaggaggcaaaaagaaaccttgtgcagggaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaaaataagaatagaatttatatttcatatgttaagtactaaaacaaaatcttaggatctgctgacaagttagagaatgcacaaagcaatggcagatattttgaaaaatctagaatttaatcttgactattgtgatttgcattctgtagtttcatctagctgtgcaaggaggggtagaagtgatgttatttcaatcagctagtcaataatatttaaaatggaaatgcattagaagactatcccatatgacactaaccatggaaaatgaagaatacgattaagagtaaatatttaaactacagccctgggaatggagatggtggtactgggaaaacccagctaagggagaatcacgtgagtagaaaggaaaatagcttgttcttcttgtgggaaattttaaataactacttgattagatttttctttctatttctgttttaataggaaattattttgaataggatttaaattaaggaaatatttctaaacctctgatatcaagaataaactagataaaactaacacaattattttcagcaaagaggaaccaagaacttaaagtcataaattagcttttcttcagttgaatgctgaagaactttctttttttttcatctaagattatgcagccaactcatttcaaaggccatttaaaagcaagattggatttttggaagaaagaacagaaatacccatagcagtctatgatcttaaaggaccaaatagagcacagaaaagaacatggcgtgaattattcaatttcagttctgttgccacattcatattgtcaaagctgaactttttacttaagattctacaataccttgtaactatttaaccaataaggattctgtttccaggtctctaaatacttgtgaattgttaaaccatatatttatttggatttttgtgtccctattcataattatagtatctgatagggttaacaaatatttacacttttaatagcaactattaaaatatagtaggttttcagactttcatacatgtgtactctctctctctctctctctctctgtctctctctctctctctatatatatatatataattgtgccttatattttgttacagaatcactagagatatattctcaagtaacttgctagtaaggagaacaacctatgagaggtgaatattaaattttagcaatattttctttacattagggactaagtattgattttagaatttctttctctaaagattaataaaaattaataatattttgaaagagtgtctcaaaatgatttacaatctaatatttttttctgagccaccttctcgttgttcagtgtgagtgattgagatgaatgattgatatccaggtttctctgtttgctaggtaaaaataaagagaaaattatttaaatgtatcaaatagtaagatttctctaggtgattctccctgggtctgattctaacataaattaagttcctgctaaattacgttgcaatgtgagtaataaatgtttgttgatgactgagttccgttgtaactataaattgcctgtaacaatgagcagagggtaagcttggaatttaagacatattgtagacaagtgtcttgaagaaagcaaaaaaaaaaaaaaaattcctacattttagtgaatgctgtgacatttctctctttgagaaaagaggatatgctattatcttcctgggcaagttgaggcagaatgggatgctaataagctccagaggggcttacactaaggagttggatttcagttggaagaagggttctagtggctaaaaggcaataagaatattcctaaaatatttttgtaagattgtatattgtcttgtgaaaagatgctattaatacattattaaagagaaaaggaaagaaaacttatttttgggagatagtatagcttaatgaagaaaacctaaagtcagagagatgcaggttcaagtttcagctctgccaattactagttacgtggtctttgtcaacattgccgagcctgtttctctgtgaaatgaggatactaatacccagtagggtttgggggacattcagaaaagagaggattggttgcaaggaatgaacatcccgaaggattacaatgagacagggggaggctgctcataaaaaaaaaaaaaaaaaaaaaaaaaagatagaggatagaagttagccttggaggctattaaaagagaagcttaattattcattatgtgtataaggaaggagtctttattctaggaatgaaaaattcaagagacctcagggtaggcagctaaggaaaatttaaggaaaggaacaaagaaagcaacacagaagaagaaaaaaacaaagaaatgaatgaagtatatagttttctcagtattgaataaagccaaatacattaattattaaattacataatatctccttctcattattgtttaaacagaagatttatttatagttatttgaattgctttgaagggttggttttagaataagttccaggggcaattggagttaaaaaatattattaaaattattaaactattccagagcacagaaaataaacacaacttcaaaaatattgaataaatgtattaatgtgccaagtgatcaatataatacagaatggaaaacaaaggactgtgtaactttgtctgttaacctagatgtaaacatttaaataaaagtttaacatattaatctaatagtataaaaataagaattcaacgtgcttggttggattttgttacagacatatcgggtggttgtaaacaggagattgtatttatgtaatttttatatcaatgtgttaaaggagaaaaatatgtttatataaaagagtctggaaagaaataatgattatttcataatggaaaaaaagcaatgtcactgacactatgatcattcaacatttttttaaaataaattaattttttttagttttagggattaggcctcactctcttgcccaggctggagtgaagtggcgcagtggcacagtcatagctcactctaaccttgaactaactcctcaactcaaatgatcctcctgcctcagcctcccaagcagctgggattatagacatgagccaccttgcccagctcagtatcatttttcacattcaagctaatgaaataattcaatagaattaaacaaatgcttttcaaaaatgaagttggaacaattagtcatccatagacacaaaacaaaataaaccagcagacaaacaaaacttcatattaagcctcatgccatgtgtgaagatatacaaaaagtaactcaaaatagagcagggaggaatatgtgaaataaaactataacattttttaggaaaaagccataggagaaagtttcaagaccaagaaataggtgaaacattgttagacttgacagcaaaagcacgattcataaaaggaaaaattgattacctggatctcataaatattgatacctttttctccacaaaacattttctaaagagggtgaaaagacaacttacagactggagggaaatatttgaaattcacgtatctgacaaagcatttgtatttagaatagacgaagaactcatcaaatgcagcattaaacaaacacaccaacgaaataattcagttagaaagtgggcgaatgacatgaacagatatttcactgaagactatatgggaatcataaataagcacattaaatgatgttcaacctcattagctactagagaaatgcaaattaaaccacaaggggatatcactacacgtatataagaatagccatttttttttaatgacatcaaatgctgccgaagatgcagagaaactggatcatttatacattgctggtgagaatgtaaaatggtaaaactactgtaaaaaagcatatggaatttttaaataaaactgtaatgtgtttacatttgacccagcaactgcatatttgggcatttatcttggagaaaagaaaatgtatgtttgtacaaaaatctataaaaaaatgtttatagtaactttatttttaatatccccaaaccagaaataacaataactcaaatgttcttcaatgagtgaagagttaaagaatggtctctcaataccctggaatattactcagccatcaaaagtgatagattatttatacattcaacaacttgaatggatctcaagggaattattctgagtgataaaagccagtccaaaagcttaggtatggtatgattgtgattatatagcattcttaaaattacaaaattttaaaaatggagaacagagtagtggttggttgccaagggattgggtgggggactgttaatgaaagagtggcagaagagatcctagtgatggaactgttcttgactgtggtgctggtcacctgtgatgcagttgcgtagaactaaacacgcaagaatgcacgtgaataaatgaatacatgtaaaactgcagaaatctgagtaaggttgatggagtatatcaatgtcagtttcttttcgtgatattattatgcaggatgttacttgtcattgagagaaactgaatgaagagtacacagactttctctgtaatatttcttgcaacttcatatgaatcttcaattacctgggaagcaaatgcatacatagtataattagttgcttaaaatttggaaaagaaagaaaaaagtaatatgtttacagatgctataatttaatatgtagaaaataaaaactcataattgaaatgtttaagaaaatgtgatatggtgtaatcattaatcttataggtataaaaataatttagaatgggaatgggaaatattctgttcacaataccaaactatatatactttgcactaaattcaattggaagggcaaaggacttatataaaaaatcaaagataaaatagtattaatgtacataaaatgaggatggaatatttctgaatgaaaagccttaatattgtgaaatgtttaaaattttccagttttcactgttgtgtgtatgtatattatatatagtgttattttaataaaatttctatttgagttgtaatatgattttaaagctcacatgaaagataccatgtttgaaaattaccaaattattattttaaaatttatttgaaaataagattatttggtgtggtggacttacagccttttttttaagttaacatcttcctaaaaaatgtaaatgaaatatgtggaactcattaggaacaaactaaatgtttttggaagacaaacagatgcatgcatataaaagaaatttatatatataatacagttaattttttaaatttaatagataaggatcatttaagtttgttagcataatttctctcactgaaataagtacatgcctacctcccacctttacctatgtaaatttattgtatcaaataagtcaatgtttatcaaatatagatgataaaatataattctctaaaaattgaagggatctgattagacaaaataatggtaaatttacgtgatagggaaatttaaaaattttgaaacttatctatatcaaacttttgttttattgagatacctcatagaataaatatatttctgaaaccctaataaaattagctcatctgattaaaatcccatacttttatgatggaagctgaattctggaattaagatattttttcgcttgtgaaacaaaaagcacttatccttttatcgcaaatgttcttcctccttctcctgcccctagtattcccttcctctgccttttgaaacatgtaatacccagggtttttttaatagtttttttttataatagattatttttcagagaaattttatattcacagcaaaattgagtgaaaggtacaggaatttcccatattctcttccccctgacccccctgtgcctgatacagaccatgcatagcttccccaattatcaacatcccgcaccagagtggcacaattgctatcactcatgaacctatattgacacatcattgtcacccaaggtctgtttggattcactttccagtggattgtgttgtatgggtttggacaagtaaataaagacatgtatccaccattgtagaatcatatggaataacttcaccaccctacaaattctctatgttcacctgctcattccttccctcgcaattcctagcaaccactgctatttttactgtctctatagttttgctttttcaaaatgtcatgtagttgagattatatactatgtagccttttcttactggcttctttcacttcataatatgcatttaagtttcctccatatcttttcatggcttgatagctcattttttttagcacagaataataactcattaaaaaaatgtatctatttagccattcacctattgaaggacatcttggttgcttccaaattttggcaattattaataaagctgctataaatgtttgtgtgtaggtttttctgtgttaatatgttttcacctccttttgggtaaatacaaaggagcctgattactggattgtatgataataatttgtttagttttataagaaaatgccagattattttccaaagtgactgtaccattttgcattcttacccaggaattagtgagagttggtcattttatgtttaagtgaggccttctctgattttttctgtgagacatttcctttcttcaaactcattaagcactctctatccttatactgacatctattatgtatgtatgtgtgtgtgtgtgtaatttgttttttgagacaaggtctcaccctgtcacccaggctggagtatagtggtgcagtggtgcgatctcagctcactgcagcctccgcctcctgtgttcaagcagttctcccacctcagcctcgcaagtagctgggacctcagacatgcaccaccactctaggctcattttttgttttatatattttggttgacacggagtttcaccatgttggctaggctggcctggagctcctgtcctcaagtgatccacccgccttggcctcgcaaagtgctgggattacaggcatgccccactgcgcctggcctgacatctattatatgttttgttaagcatgtgcaaacccctcagggcaggacagagatatgtctcctatcctttacagtactgcacttgttgccttgaaattttttaatgaaactagaaaatttgtgaatgaattaagaaattctggtgtgtcagactgccaggcaaatgatcaaatatatatcatcacctaacagcatttcgttttgcaaagctctatacaattacaatgtcttatgctaaaattataatcaaacaatactcactatttttactataattttttttccattttttcttggcagttattttatgggttaaatgcatgattgatttatgtgaaagggaattgcatttgacgttattgactctttgccccagccttttcagctagaaaaaagcaaagctcttgctgtaacaagtgctgaaccttttcagaataaaatctaatgaggttagtatatatccttgacattttattttcaaccgaagtgaaggtcatagctgaaaggtcacaaagatgaatttatacagcaaataaacaatgttattattttgcaaagaaaatgcaatattcctgtctttagcctcttgcatgtaaaagggtgtttgtaatgctgattttagtattcaagtcctgttatcttttcatttcttatattttggaatgtagaaagaggaatacacctagcttatctataaaagactagtatgaaatgtgtgtattatcattaatattctagtattttattatttgaactttacatttaagtcaaatctactttgtatttgttgggtactaatttttttggtggaagtaggtaattactctatttccttggtaaacttctttctgacttgagagtttagtcatacataagtccctcaagtctaccatctttggtttttaacaacaaaactgtacatttccaatgaaagaatatatcaacataagtttggaaaataaggggctgaattatagttaaatggtagaaaatctgcctttttgggcacaatgtacaacaggaattcttaactgctttcatattatattactaatacgtaacatgggattgctctattaaatttgtaccagatcaagacaattttaatagtaaaaatagtttcatttatttaaaaagtcattaaacaaagttcaaatgccaaaaaccatgtcaaaatggtcactttatattgttatgtagttaatatattttagagcaaatattccaaattttgtaatttgctccttttaaaaaacaagcataagataggcatctaacctagaatttcctttattttagatgaactcacaaattcgtcagaaaccagattgtctttggaagacctctttaggaaagactttgtgcttcacgatccagaggctcggtggatcaatggtaagtgtatacctttttaaacattgtattcattttgagttctgtataattaaaattttaaaaaatgagatgtgtaagctgggcgcaatggcttatgcctgtcatcccagcaccttgggaggccaaggcaggagaatcgcttgaacctgggaggcggacgtcgcagtgagccgagatcgcaccactgcactccaacctgggtgacagagcgagactccatctcaaaaaaaaaaaaaaaaaaaaaagatatgtgtagttaatatttaattgaaagtgtacttcaaagattacatgggtattatttaaattaaaaccttggttcttgtgagagaaaatcaattcctaagatagggcgtcaataaattatttggcaaacattgggttgacagttttgtatctgctgctctctcatgatcattagttacatgactttaaggatgtattacatctctagcacatcactagataatttttcttagtttggcagtgtacattttgggagctagtacgtagaaatgttaagtgcttcagatttgacaatatgattggtttttgttattctctgtggcttttctttttaagcttaagtgttacaagctagtgagactctatgcaaaattgaaatgacttggaaatatatggcactttgttgtttttttttctggcctggcaaataggactccttaggttctcttaagtcaatctctgacataaaaataagaaaataaaaccactgagtggcttcataggttttgctttgtctttatggaagatcataagggcataatgtgttggtgaaaaggaaatcagttttttaatcctttgaatgttctaatttgaccaaccatacgaatcattatggttggatagctgttaatctttacccttcactttatttgggcataatatctttgctaattttcaaggcatagagtgtattatttgtataatagatgaaaggagctttgccttttcatataataaagatcatcatacttacagtccattccttcctctctcttactctacttaagtgtatttatgctggtgaattaaactttaatttatggaagctatataaagagaatgtaatttaacccatgagggcaaaggccaaatcacgtgtgtttacttgacactgatatgtctcctggagatctgcaggcactcgagattggttttttgaataaatgaatgaatgattttaattgatgtgcagtctcattttcacataaacttaaattttaattgaaatcaattggaagataagtgtgtattgtgatgatattacggataaagaacacaaggtagcgtttttcttaatgaatctgtatatttttattttgaattgtttataaatttgaggctagtcatatttttgcctttgtactgtgattatttcacatatacactataatgagtgctatgactaaagaaggctaataaaaaagatatattatcacaaaaaattgtccaaatacacaaatctctcataaataattcttctaatgtgtgattataattatgacaatcacctgtttactctttagcaaatattttctattgagagaaatgacaaaatgaaagttgctaggtttttttaaacagtagtattatgagttgttagatttgaaatgctgaataatcttgttttattcaccatgtttttggacaaattatagacattttgtagtctttgactttggaaaacatgaaaaattatgggtctcatctcccttctcaggttagcttggactatttagaggcatttactcctgtgtataactgactctgtgatattgaagctccgaaggacaggacagatatttaagtagtgaactgcatgctaaattaaaacatatttcaatatgtaggacacagattctactcttatacttcataggttaccaaaataatatatttggagtttatcatttttcaagtaatttctttattaatcattggttaaatttgatcctaagaaggcatctgggacaaagctgcagtgttattataatgttctaagtaatacctaaatatataatttttataaagaatttgacataaagacaactctttaaattggaataaacagaacctaagctctgaaagaatgcagtctttataaataccattgaaggaactgtctcaatgcctgtaaattgtgtgcactgagttactttttaagtatagaaatggatttgtgcttttatccaacccagatctttctggcaagtgctagatacttggcctatttacgtattcctcacatagcctggaaattcaatgggaaatatatgagtaggatgtgtaaccttggcctcattatcaacagttatatctaaatgtaacctgtgagctttttctttattctcaagtgatatctcaacaggttttctttgtacataagtcacttgaaggagttcgagctcagcttatttggaagcatcatttaattcttggaggtcatcatagaagtgcttaatgcattattggtcaaggggaaggagggagtctagacggccctgacatgtgtaggttatagtgaggcgatgccattcattatgcttggtctcaaaaaatatgtctgagaatatcattgcagtcttggatgggtgcccctgttcatggttagcttaacaacggccttaccccaagtctgctcatatctttgaaatctacatttttatagcatcttcattctagcaatgtcaccttgaaatttgaaaacccatcttatttaaaattattcattctatccacacacatttgataatcaattaatcaccaaagaaagatctaacattgagtgccttctattgagactctgtgatcgatgctttatgtacatatttcacaggactgcatatgacattaaagttaaccccagaaaactgaggcttaactcagaaacttatccgaacacacacctaataaaaggcagaggctgctttactcattatgcttaagtataaaacttgacctctttcattgtttgactctgatgtgtcatcctcatatctaacatatttatcaagcacctcactgacaatctcattttaacagacctcattgctgtcgtagggtggaaaggtatgaaagccttcctcacccatcataaaggtcacagccaacactgctgtaacaaaagaccagttaaaaagagaaaagcataacaaatttatttaatgaaagttttatgtcacttggaagactttagaaatgaagaatcaaaggcctagggaaaactgtccatttgtatgcttaggttaaataaagtacggacagtgtattgaagtgtgactggacaaaaagggtatactctaatgataataaaatgagggagaaacccagcaaagcttacctgttcagatccttcttggcctccctgtgtagcatttcatcctgccagatataaggcagaactcccccggaaatagggtcttatgatctattatctgaaaggtaggtcagtgcatttccttgtgacagctcctacacagaaaagcagaggaaggttaaaatatttttaaatcttatggtttgcttggaaagagggatgctagtttcttttattattgttattatactttaagttctagggtacaagtgcagaacatgcaggtttgttacataggtatacatgtgccatggtggtttgctgcacccatcgtcccatcatctacattaggcatttcccctaatgctatccctcccctagtcccctaccccctgacaggccctggtgtgtgatattcccctccctgtgtctatgtgttctcattgtgcaactcccacttatgagtgagaacgtgctttgtttgtttttctgtccttgcgatagtttgctgagaatgatggtttccagcatcatccatgtccctgcaaaggacatgaactcatccttttttgtggctgcatagtattccatggtatatatgtgccacattttctttatccagtctactattgatgggcatttgggttggttccaagtctttgctattgtgagtagtgctgcaataaatatacatatgcatgtgtctttatagtaaaatgatttgggagtaatgggatttcaagtttttgtaacctttcctggggtagaggaatctggtttctattacttgcttcagggatggcagagaggtaggagacaggaaggcagaaggaggtcagatacagactttgcttctgagactgctcagaggccttccaatatcttagtcagttcaacgtactcagcatgccaccatgccatacttggaggtatcattttctgagtcccaacactattaattttttcatgttgaatactacaataatatgtttatttccccaggtacattcatgtagtggtaacttatacagtcactaaaactagagtttatacacatgtttattgacttgatcatgatctagaaaagtgaacaaagtaacttcaaaacagcattgatagtatgtgatatcacattgtctattgtgtaacagtgattgtctccagattatccctttctttttacttattttgttttttctcgatttttttcaataaatgcatgtgtttacatagtttttttttataattttaactttttattttagatttagggagtgcatgtgcaggtttgttacatgggtatcctgcaacgttagcactctcaggatattcattttgagctattagataaaatcaatcaagtgctattttatttttaaactttgttttccactgtgtcagaagacaattccaaaatttatctgatggagtataaacaattaaaattatcatttgataaaaaaaagttgtaaattttaaatacatttgggttccagtggacaaacataccatcatgtaatgagattttaccgtgcagctagtgtgtcctttactcaccccatgagtttgacaacacctgctcagtgatattggtccacttaccatttgttatgaacctgcagcaatatcaaattgctatgaaaatttttaaatgtgtacccacaattaaacctacctgctctggaccagtggtcaacccttcaccaactggctgtagtaagataacaacactcttagcacagccctttcctaggagactataaacgatgaggaataactgtcagtattcaatgagtgctccataaatagtttcattataatgagaacagtgtatatgtaatgggatagaagttgtttcacatttcttttgcaaaatggcatgctgggataaatgataatatgtgaggctttgggttttattttgatcttattggactcatgttggaaaaaaataaactcacttgttacatgagattccaacacagatattttaacctgctgtctttgtaacgtgtgacagtataatatgtggaaatgggagactcattaaatcaaggtaagccatggcctttcagcaagttatctaagcctcttaaggcttggtttcttcattcagagtgaggacattagtgccatagctagaagcataatacaaagtaagtgagcaaaaatatgtaaaaagtgaagataaaaggtaaaagttaaaaaaagaaaagaaaaaaactataaatgaaaagtcaaggtctgtagccttgtggatcttcaaatggtagcgattcatagaactgatgttagagatgctctgaacacctgacatttgttaataaatgcgctgggaggtctcattctcataatatatgcaggatattgaagaggcagtgaaaagtcactattgtagcctgtatgaaaaacaagaaacattattgtaatatatcaataatatttacagtaattaggggaactgtaaataggaaaactaaacaaatacatctttgttgtttcttgcttgtttgtttgacactaatttgtcatactagaattattgtccatcaacttcacttggtagagctgcagaagttgttgtgtttctcagtgcacagggagctacttctaactccaaagacatcattaccctccctttagcctatattcagcccccagtcaaaattatcttatgtttatcttattttgtatcttcgtgaccaaagtgttattttttataatcatcaaccaaactgatagttaaataaaatagagttgaatttatattcatgaggctcttgaagataacacgtatttttcttgcaacataatttataaagataaaaccttgcatagattctagatgcacacaattaggtatatggtcaaataaatcaatttgcatctttttaatggaaaactaaacagctgtaaaaattaatatttaaaatattagtgacattgaaatatgtgcagataatatattaattgaaaatagcacaatatggaattatatatatagtgtattcacaattgcattacttgcatatacacacaagtatatgcaaagaaaataatacctgaattcaatatgccaaaatattaaataattttctgttagagtgattgagttgtttttattttttccctttctgtctatattttccaaattttcaacaggcattctgctgtttcctactatggcaattttatgtactaactacggatattcaaacttttgtttgaaattcaaacctaacaagtaaatggttactaaaattctcattatggtagatgcattcagctagacaaatattaattttgttattctgcctgtgccttttttctcagagatctgtatgaaaaggaggtacagagaggagcgtgaggttactgaacctgggagaatgagaatgttcttagcacagcaatgactattagacttaagaggcatggattcttataacagcagtttcacttccttctttcccaatagattgagacataatatttcctgtagtttattatgttcttttttcttccactaatccaaacctctgcaacatgcaatttatctatattacaaacctaaatagtaccctagcccccaaagggtttttttaaaaagtcaaaaataacaaatgttgatgaggctgtggagaaaagagaatgcctatatggtgttgctggaaatgtaaattagttcagccactatggaaggcagtttgaagatttctcaaagaacttacagcagaactagcattggactagcaatcttattaatgggtatatacccaaaggaaaataaactttctaccaaaaagacccatacatttgcatgttctttgcagcactattcataatagcaaagacctgaaatcaacctaggtgccccaaaatgtaggagcggataaagaaaatgtggtacatatacaccatggaatactgtgcagccataaaaatgaacaaaagcatgtattttgcagcaacatggatgcagcaggaagccattatcctgagtgaattaatgcagaaacagaaagctaaatatcacacattctcacttataagtgggagctaaatcttgaggatgggcagacgtaacgataggaacaacaggcattagtgactccaaaggtggggagcggaggaggggaacaaagcctgaaaaacttccttttgggtactacgttcactatctgggtaactgggatcaatgaagtccaaatctcagtatcatacactataccttgtaacaaatccacacatatacccccaaatctaaaataaagattaaaattttaaaaatcaaataaaaagtaaaaacacataggaggctattgaaataatgacatacctagttcctgattcacagaccagagacttgtaaatgaaatttggaatgtaaatcatggttatcaaggctgacttttcttttcagagttatatatgacaaagtatcttcctatcaagagtagataatttcctactaaaactaaacaaatgcttaaaaagcataccatgaagcatatttacttctctccaaatgaccaaaaatgttttatttattgctatgttgtttgtaaaattgtgcttttaccaaagtttagattaaatttcatctgtattaaaactgtttgaaatcaataaaatggaaatatctactataaaaaatcatactgtggcaatcttacatactaactacgatattcaaacttttgtttggaatttaaatctaaatagttttcttcaagaaaatatttttaagatttcagtttgtctaaaaatgacaatacttaaactaaacaccaagagagagaaaagggatttactgataaaattcagtgttaacatttaggaacaaaaaagtatgtaagaaaaaaatatatttctatcacctaggtatgcaatgatcaaagtatttaaagagaatttgaaacacaaactaaactttagaataaagaagctaaatatttatgttaccacttatttcttgaaatataaaactatattttgatttttaaaataagaaaaaaaagcttggggaaatgggatgaaagttatgttcagagttcatcaacaagcatttattgagcttcatatatgtgctctgcacagagcttcatatattccagatggaatctgtttacatttgaaaagtttgtagtaaaatatctggtgtcctcatagtcctttgatattctatacaattgttggtcttggccttgatggcccaggaaatctgtttgtcaatacaaatatagaataatagatacattgacattgacatctatctttccatctatatatccatctatccttttatctatccaacatgtattgaaaagattgaagcacagccaaacatttttctagatacaaagatataaaggtgaataaacacagtccctttgatcaacgacattatgaatataaagggtttttttcctcattgagcacaaatctttccagttgtctcaggcttaaaagtaaaattgtaatcaaaaggctgtgaatgggacagaaagtagacataactgaagagttgcaagaaatactcagtccaattacgatgaagttttattaaccttctccaaaatcaaaaacacatcttcacatcctacatctctctctttactatgatgcagggtacacatggcacattttatttttttgagctgctgtgtacgccctgcctctctttttatttgatacagtcttcacttacatatggtaatgatcatgactaatatatacatgtaccactgacatgttcaaaaaaaaaatataattatggtacccagagactatagaaactagatcaaaataataggcctaaaacaattaggtgaacaataattaggtgatccatttctgggtaattattttttaaaaacagatgttgcaactaggagaaatcggtttgagttaagaacggttggagtcgtctttatggaaaagataaaattcagtcgcagtctagagggcagatgagcccaggggatgaatgaagatattgttgggagaacaaggatgtgttatgacaaaatcacagaaattagcatggtgtgtaagtttaacggtaaggaaaatgctgtgtatgtgtgttcggggcctctctatgtataaaagtaatggaaaataaagttgagtaactcagtattggcatatgattagaatatgtatatttgatcattttactgtaattgttatactttgatctcctttagcagattaaccctttattagctcttaatttgaaacagaagaatttaaaattgctctgataaatgtcagctattttgtgggaatgggagttgttagtagtaggaattgaagtgggagatattagtaataggaatttacctaatacgtgttcagtaagtcaaaatttgcatgtatgtttctacttttctaggacacttctacatatgctatttatttgcatttttttgaaaacccttcttagggaggcaggatgggcattatttttgttttatacatgagtaacttgagaagcaggttttttccacttctctcagattcactcagtaataagttctggctagaagccacatctttcatgtttaatgtttggtggaaactagagtagagaaaacgtttcaagtgaattttttttattatcatgaaactaacatttgacagtgtttataaattaatttttaaaacacatagatttaaggaaaacaatattaaaggaaaagtagataagaataaggaaagattttctttgtaattgtatatgaatgtttccattttattggaatgtttagatatttttagaaaatgtaattgttcttatatgattgattttacatgtaaaaaaagaagtcattgcagataatcataataagaaactgaaacttaggacatattttcattttttaaaaaaatgtattctttcttgtcaacttttattttagattcaggggtacatgttgttacctgggtataccaggttgttacctgggtgtgttgtatgatgctgaattttgctgtatgattgaatatgtcacccaggtaatgagcatagtacccaacagatagtttttcaaagtttgtctcccacattccctccctaccccctcttattttcaccagtgtctaacattcccatctttatgtctatgggtacccaatgtttagttcccactttgcttgtggtatttggttttttgttttggtttttagttttagtttttttgtttctgcattaattagcataggataatgtctcaaaatgcatctatgttgttgtaaaatgacataatttggcctttttatggctgcatagtattccatggtatgtatgtaccacattttctttatttcttttttttttcctttaagttcatgtgcagaacgtgcaggtttgttacataggtatacatgtgccatggtggtttaccgcacctactgatttgtcctctaagttccctcccctcgccccccacccaacaataggccctggtgtgtgttgttcccctccctgtgtccatatgttctcattgttcaactcccacttatgagtgagaacatgtggtgtttggttttctgttcctgtgttagtttgctgaggatgatggcttccagcttcatccatgtccctgcaaagcacataatctcattcctttttatggttgcgtagcattccgtggtatatatgtaccacattttcttcatccagtctatcactgttgggcattgaggttggttccatgactttgctgttgtaaatagtgctgcaataaacatacgcttgcatgtgtctttatagtagaatgatttataatcttttgggtatatatccagtaatgggattgctgggtcaaaggttatttctggttctagatccttgaggaattgccatactgtcttccacaatggtggaactaatttacattcccaccaacagtgtaagtaattgtaaaagtgttcctatttctccacagcctcagcagcatctattgtttcttaactttttaataattgccattctgactggcatgggatggtatatcattgtggttttgatttgcatttctctaatgatcagtaatgttgacctttttttcatatgtttgttggccgtgtacatgtcttctttcgagaagtgtctgttcttagcctttgcccatttttgatggggttgtttttttcttgtaaagttgtttaagttccttgtagattctggatattagacctttgtcagatgggtatattgcaaaaattgtctcccattttgaaggttgcctgttcactctgatgatggtttcttttgctgtgcagattctctttagttcaattagatcccatttgtcaattttccttttgttgcaattgcttttggcatttttggtatgaagtctttgcccatgcctatgtcctgaatgatactgcctaggttttcgtctagggtttttagtatgttgggttttatatttaagtcttaaatccatcttgagttaatttttgtttaaggtgtgaggaaggtgcccagtttcagctttctgcatatggctagtcagttttcacagcaacatttattgaataggagatcctttccccattgcttatttttgtcaggtttgtaaaagatcagatggctgtagatgtgtggtgttatttctgaagtttctgttctgttccattggtctatatgtctgtttttgtagcagtaccatgctgttttggtgactgtagccatgtagtgtagtttgaagtcaggtagtgtgatgcctccagctttgttctttttgtttaggattgtcttggctatacagggtcttctttgattccatatgaaatttaaagtcgttttttcttcttctgtgaagaaagtcaatggtagtttgatgggaatagcattgaatctataaattactttgggcaatatggccattttcacaatgttggttcttcctgtccatgagcatggaatgttttccatttgtttgtgtcctctcttatttccttgagcagtggtttgtacttccccttgaggagcaacttcacatccctagttagctatattcctaggtattttattctctatatagaagttgtgaatgggagtttattcatgattttgccctctgcttgtctattgttggtgtaaaggaatgcttgtggtttttgcacattgattttgcatcctcagactttgctgaagttgcttatcagcttaaggagttttgggctgagatgatggagttttctaaatgtagattcatgttgtctgcaaacagacacaatttgacttcctctcttcctatttgaatacccttacttctttctcttgcctgattgccctggccagtacttccaatactatcttgaataggggtagtgagagagggcatccttgtttttaaccagttttcaaagggaatgcttccagattttgcccattcaatatgatattggctaggggtttgtcataaatagctcttattattttgagatatgttgcatcaatagctgttttattgagagtttttctttatccagtccactgttggtaggatccttggttgattccatgtctttgctattgtaaagggtgctacaatgaacatatgggtgtcttcttggtagaatgatttattttcctttgggtatataccaagtaatgggattgctggattaaatggtagttctatttttagttatttgagaactctcctaactgctttctatagtggctgaactaatttacattatcaccaacaatgtttaagtgtttttgaaccattgcccctttcctctctcccatcttttgtattatccagcatctattgttcccatctttatgttcatgtgtactcaatatatatttcccactataagtgtgaaaatgcagtatttgatttgttctttctttattaattctcttaggattatgtcctaatggataatggatagtgacctaatagcctaatggataatggtccaagttcagagtctcatctgagacaagggaaatcccttccacctagtgcctgtaaaaccagaacaagttagttacttccaagatacaatggaggtacaggcattggttaaatatacccattccaaatgagagaaattggtcaagggcctacaggccccatacaagtccgaaattcaataaggcagtcataaaccttaaagttccaaaatgatctcctttgaacccatgtctcacatccaggtaacactgatgcaagaggtgggcttccacagacttgggcagcgccactcctgtggctttgcaggctacaacctccctcctggatgctttcatgggctggtgttgtgtgtgcagcttttccaggtgcacagtacaagccgtcagtggatctaacattctaaggtctggaggatggtgggccccttctcacaactccactaggcagtgccccagtggggccactatgtgggggctcctactccacattttccttctgctctatcctagcagaggttctctatgaggactccacccctgcagcaaacttctgcccggacatctaggcatttccatacatcctctgaaatctaggcaaagtttccaaaactcaatttttgttttctgtgcacccataggaccaacaccatgtggaagcttccaaggctagggatttgtatcctctgaagcaacatcttgagctgtaccttggccccttttagctaggtttgaagaggctgggacacagtaccgaggctatacacagcaggggggccttggacccgacccaggaaaccatttttttctcctagccctctgtgcctgcgatgggaggggctgctgtgaaggtctctgacatgccctggagacattttttccattgtcttggtgattaacattgggccccctgttgcttattcaaatttctgcagcctgcttgaatttctccccagaaaatgggtttttcttttctatcatatcatcaggctacaaattcccaggcttttttgtttgcctcctcttgagcactttgtcacttagaaatttctgctgccagatatgctaaattgtctcactcagattcaaagtttcacatgtctctagggcaggggcaaaatgctgccagtctctttgctaaagcaagagtgacctttactccagttcccaacaagtttcttgtctccatctgaaaccacctcagcctggacttcattttttacatcactatcagcattttggtcaaagccattcaacaaatctttagggagttccaaactttctcacatctgtctgtcttctgagccctccaagtctctgggaagttccaaactttcccacattttcctatcttcttctgagccctccagactgttttaacctgtgcctgttacccagtttcaaagttgcttccacattttgggtatccttatagcagcaccccactctaccagtacaaatttactgtataagtctgttctcacgctgctatgaagagatacctgagactgagtaatttataaagaaaagaggtttaattgcctcctcacagttcagcatgcctgggaaggcctcaggcaacttacaattatggtagaaggggaagcaaacatatccttcacatggcagtaccacggagaagtgctaagcaaaagaagaaaagccccttatagaaccttcaaatctcatgagaactcactcactatcacaagaatagcatggatgtaaccacccccatgattcaattacctcccaccggatccctcccgtggcacatggagattatggaaactacaattcaagatgagatttcactggggatgttgttgcatatgagatgggtttcttgaagatagcagatggttgggtctagcatttcatccaacttgccacactgtagctttcaagtagggtgtttagatcatttgcattcatcgttaatagtgatatgtgagaatttgaccctgtgatcatgttattacctggttgttttgtggactcgattgtgtagttgctttatagagtctgtgaactatgcatgtgtgtatgtttttgtggaggcaggtattgttcatttgcaggtttagaactcccttaaagacctcttgtaagactgttttggtgataataaattcccttagtgtttacttctctggaaaggattttatttctcctttgcttatgaagcttagtttgacagaagatgaaattatctgaaatttttttaatgatatgaaaatagacctacaatctctttttgtttgtaaggcttctgatgacaatcctgctgttattttgatggggttctttttgtaatagacctcacccttttctttagctgcctttaagattttttctttcacactgactttggaaaatctattgaatatgtgccttagagatggtcttcttatatctcataggggctcaacaaatttcttgaatttgtgagttgacctctttcatgagattgggtaaatttttatgaaatgtattctcaaatttgttttccaagttgcttactctctttctctcacaggaatgctattgcataataggcttggtttatttacataaccctgtatttcttggaggttttctttctttaaaattttttttaatttatatttgtcttactgaattggttaaaaggaccagtattttcattctgagattatttcctcagcattgtctattctatttttaatgcttctaattatattttttaatttctctagtaagtttctcaattccagaagttcagttttgttttttcttaaaatgcttgtgttgtctttctactcttggattattttactgctgtctcggattgggtttcagctttctcttgaatcgcattgagcttccttgttaccaagattctgaattctatgtctgtcatttcagccatttcaatttggtaaggatccattgctggagtgctagtgtgattgttttgaggtgaggagatactctgactttttgaattgccaaagtccttgcactgattccttcttatctgagacggttagtgttattttatctttcagaagttgctgtcatttggatgaggcattttgtttttatattctttttctctctggagggtgtgactgtagtgaatgttttgtattgttaattggctttgtttctgggtgctttcagagggttaagcctctgtacaggttatttaattatagctagatctctacattgtatttcacaggcagtgtgtggaaggcatttttgtttggtggtgtaattcagactgcgttccattagatggcatttaagaataagagtcagcaggtatgttcttattcaactgtgtgccttttttgtatttcagtgcatttgtgtagtgttccaggttggaggagttggggggaatcaggggatgactctctcaccaagttttcattcctgggacttgggggagctccctgtagtctctggtgctgtgcccacatttctttagctccaagggaggcctaggctggcagtgctgtttcctcccatggagtggcctgagccaaaggttaggttggcaggagacccgtagtcccctaggggcctgctatacctctgtacttgacagagtcagagagggttgtggggtatgtctgctggtggtctgttgattcagtcggtcagaggtggaggatcccaggaagggcagtgttgctgtgggtgtgcagctggtgtggtacccagggcctagagttttttgcccagagattgctgtctggacttcccagcttgtgcttgactgatcaggtctccttccagtgtctgtcccagtactgagcttgcccagctagttttgtcccaagccttttgttctccgattgcttgtctgttaggtgctgcagggcatggagctccctcaggcagaggctgaggatggcagataggccacacccttcctagattggtcttccagagcatggtatacccagctgctgtgccatcccatgatcccacacctcagtcttctctgtggtctgagagtgagggctcctctcctgcttgagctcaagatctcagctcaatacccctgagccgtgtgttcaaattctagggagttgagaccaggcatgcagctttgtccttctgcccatctgggtcagatactacctgttctgcgggagggcaaagcaattccagactaatggcgagacactcaggtggggcagtagaggttgcattgtcggcatgctcttgatggagtggtcaggcaggggctttgagggtggtcaatggacaaggggatgtgcagaccagacatgcccctttcccatgggaaaaacagccctgtttcctgcaccccctcatgcaaaatcttctgagttcttctcagatttgagctctgcctctgcttactctccaagcagttcccctgccgattcaaatgttttttggggtcacaggatctctcatagctaggatctcagaggtctgtggcaggagtgtggtgtcccgcagttcctttattcacttcttccttaggacctgttaagggctgagagccagttctggtgctcagcaactttgtgcagcttcctccctcttcatcctcagtgtttgtgttgcctctctgtggactttcagttttctcccagaggatctgcttgaggtgtgatggttcactggatattttggtttctcttggttggagagttgcttcttggctgcatctagtcagctatgttggccccccaactccaaattttcatattaaccttttaattcaacttgctttgtttttgcatgtatgtttgtgtgtgtatgtttgtgtgtgtatgttttgtgtgtatgtttttgtgtgtatgttttgtgtgtatatttgtgtgtttgtgcatttctttatgaatggctaaatttacttaatcagcttggttatacagtcaattcgaatgagccattgagaactttggataactatcactggtttctattgaataaacaagtattaaacatgtaggtgcattccaaaatgtctttagcaaggaaatttctagagataacattccttatcattaaatggctaagattctatatggtaagttatgttttgtaagtggggcaactaaggccagataccatgctctgcatttttagtttattatatctaatgtttatagttttctaacttaggtagatatatgcttattttataaatgaagagcttgagtttaaagcaaataggtgacttgttcaagaacacagagataaattgaatctatacttttttttaacttatatgtataatagaaaaaatccataacaaaaagctttatataactggcaggtgacgttttccaacttttggttaagctgagtaacaaacagtgagttccccatttctgctaatgttttagagaggttgggtgatcatgtgataaagatatattagtgagattcatatagtggatacgaaattattaaaaaataacctctaagttcaacttcaattctaatattttatcagtttatcgccatgtcaacataaaggtacagttgaagctactgttttaatttttccttgttttaggaaaccagttgatacattgttctagacctttcctagggaatggtgtcagctttcacagaaagttgtctgcttttcatttccagtcaagaaaactctagtgtttgacacatagctctttgctctttgatttgattggccatatggagttgttaaaacatttaaaagctgatctcaattggactttcagttgataacaccttggtatcctcttttgtgcagtcataacccatgccagttttcatgagcttgaacattcattactgggttcatgacccaagccattagcccatcactgccatgcacttgtcaacagcatctgaaagcatgaagcttaaacctatctggtctctggtgttattcaatttgtgagtgaaaaaatcacacactacctagttaatgtgtgtatatatttttcccttctcctttgaatttgaatgttctctgggttttctaccattaccagtaatgctaattatttaatttgtctctgtcacccacatctgtgataaaatagtttgtttgcacattgtactccttagcttttaatttctccaagatcctattatatttaaaagatttaaaaatgtgaaatctcttaagtagagaagtcactaagtccttgtagaccataaggattgcctgctctcctcagactcatggttaagtggcatcagtggtctgaaccattcagctgtgttgttctctaaggcccaaccaaccaccaaggtagagaaggaacatatctgtgaatcagtgtacagtacctgaaatgggaaggttagttctgtgtctaggagacatggtgcgcaagttacttgacttctgtcagtggccatatcttcttcacctataggactgagaggataattcctcttatgcctttcttctaaaggcattgtgagcatcacaggcctatgctttctaaacattataaaccacttaaaacattcttgactccatctcttattgaataaaatttatttttcatttctctagactctatgactttgggcaagtcaaccagtatttctgggcattagttttgtcaaagcacctgagtgataaccacagttatttattgggagttgagtatgtgcccatcatcgggccaataaggtttggttaactgtatttattcctcatgaattattttcattgccttcacttgatggctcaggaaatggagcagagagagctcggtaacttccctaggctcacatagctagttagtagcaaaggtggaggtagatgcttcaggtcattaaataaggtagcaaaggtggaggtagatgcttcaggtcattaaataaggagggattaaaatatttcatggaattatcctaggtggcgtctaggttcaaagaatgtaaaatgcagagaataaaagatctgctttttttttctttgttttggccaacttttttcaccagcctgtatttcctctcctttctttcttatctgttttgaaattccaattgctgccttcactttggcagggtagatgggggtggttagagttgccttccctactgtgcttaagttcttattgtgtaaagatcctgtaactcgctaaattagcttaaaaagctctggttttgttttcgtgccagcatattacctcaccacactatcactttttaccctccaagacttgccataccaagtggcagtgctcaaatcacataaagaggagccgttgttgcttgttcgctagtacgtgggtttgtatccccaaaccatgtcttttttacatgatactaattttgtctggaatattcttatttttccatacaaaaagcaaattcctgcttttccttatgaaacatcagtcagttcttctgtatactcaaccatgactttcccagacatcttttttttttttttttcctttaagttgccagcatgacttttatgcttagcaatgtttggattccatgttcctaaaccgaattttctcagagcagggatgctggtttttgctttctgcattttcagcatcaaacacagtatctagcacgtagttacgctgttgtttcagcaaatgaattactactttggtacaacagaccctaattttaatttgaagattgacacaattgtgaaggtatactaaaaagttttcttgaaattttagatgaaatataagtagtagaggatattttttctccttccaaaaattaaagagaagaaaatcactcagcttaattttcgtttaacaaaaaagaaccaaagtgttatgactaacactgtcacagagtatggtgtgattactgatgatcaaacttctgtagcaagttacatgtatatataaagactaatactgttcttccaattactaaggtaagttcttagaagtaaaaatatttatgtttagattcctgaaatagtcactaatcatgaaactgtattgaagcaaaccaaattcctggaactagacagactgtgatagaatccagtaggctgatggaggtactctgcatgacagcggggcagatggatttgctgaaatccagtgttgcccaactacaaatctgccataaaagaaaaatgcaaacatggagacttttaaaataggaataatttggactctcacagaggaacattttcaagttatggtttaggtgggcttcttagagccatcctagattccaagaactaaaagtaactgcagacatcaggcagagatggtccaagttgtcaagcagaaaataaatgcattactcaaaacatgccatctcttcataagcactcttagaatttccatgtttaagaatttatttttttttctaagactgggattctttatatgaaagtatttttttttctccttggttttttaaacatctcaatacaatggcaattaattctggaaagtcaaaaccagaaagcgttttagagagtcttccttactttgccataaggtatttaagatggaagtctgttttagtttttcatagatcttacaaggcccagtccagtgcttaaaacattttaatgttcaattaattttatttgagctaaattggattcatatctactgctcaccaccatccacaagcatcatttcaaacctgtttgggaattaaaataaatgaatcctgggatgactatggtttgtctcaaggtcaaaagctgtgacagagctagatttaacatcaacagattccttcttatttatgttactaatgagtattaatatatattactgaactttttgaccttctgtaatgaaaatttctgattatagatttattttgttatgctaaaatatatgcaattttaaagaaaaaggacaccatcagtggttggcagtcagagccagggattttcttgagagctgatactgaagtattattgaaatgatataataatatattattgaaataatattttttttccattttcttcccaaaggatgcctataatgctctggatgactctccactctcagccttttatatctagcacctcattcctgaaaactttcatctcttttcactattccatgtattctgacagcatccgaaatttaccttacattacttatatcattttcttgtgtataggaacaattctactcattaataccaccactgctgctattgaaattttggttctatgaatatctcaattatattccttcttctttactttattatatagcctttttgtcctggtttattccttagagttttatgctttgcttatatacaatgtacattgctatgtatgtctttaagttagtgtacagatttttaactgtcttaattgttttagaaaaatatctagtcttccaaaagtagatcaatatcagttaattggcttatctaccgagtccttaggatgatgttgtatttgtcttcataatcattgatttatttgttcctgtttgtctttgaaggaaggtctgtctatctagactcagtgtttatttctcttgactttgctgggtcttccaaggtccacacatccacaggtgcagttgcctagctcccagctcacttctcagtgtctaatcaaattccaactgttgcattcctgtaataattgatattgtgtctttacttatcgctccaattcttaccccttcagcactgaaaacagatagtgtacatgaaaaatcacattgcacccccagcagtatctttttaggaagatcggtgttggtcatgcccaagacaaaactccttagttgtagggaccttatatcccgcaatatgtggaatccatcactatcttcttaacccatcctatatacgaagatattttctgcaatttgacgtccctaatagatattgtaagagagacactatagggaggagagggttggaaagtaaaggtcacatactttaagtagtacctaagcagcagacagaccgcccataattatctgataaatgcagccatttgaattttagatgtaatggacagacagtcagacaatagtaccatggcatagagttttttttattttggttttgattatgtttgtttgtgtgtgcgtgtgtgtgttgtttttaaactactttttggcaacatagcctggtggtccaaatgttgggatttttagttaaattctagaaaatatataggtcacggatgttcttcccagtgtcttaaaggttgacggttctagttttcagtgtaatatgatgtctactatatacaactatatatgtctttattaacaatctaatagagcttttggagagcatgtgacaaatacagctaaccaggcacaattttaatattaactatcatatgactttttacttttttacgttttaaagccaactttttctactttctttatacttttctaagtgtttcaaattattaaaatatgtcttataatttttaaagatcctaggattaataaatcactgaaactttaacgaggtgcaatatcaaggcagtcttttgtttcagaaaatgattacaattattaatgaataacaagcactaatacaactttgtacatctttttgttatgtgtatgactgacatttatttatttgaggttatggtaaaattaaaattctatactatatctaataaaactagttttagtatttgtgcaaacagaagttgacatttgatggagatgcaaaaggaaaaaaatactcattattctaggttttagattggaatctaaacatttctaattgaaaacagtttaggaattaaagaaaccttgtcctagttctgccttcctctggtgtgtgtttaggttcatgtcccttaatctaagggaaattagatagctaaaagtcatcagtgaattcagcacacctttattttagcctttgctgtaaattaaggtctgtgaccattattgaaggtttacctgaactccttacaatattagttttccatttcttcttgtcctgagtttgtgctaacaaaatcatacgaagaaaaagagaagaaaggccgaaattatgacagagagagaaatataggatagcttctctgaataaagcctaagcctggggacaggaagtctacagtgtgccatatttctctcctttccttctggtagcccctgggggccattgtgaaatctccagggagtccaggagcacaggatagaaaccatgacatgggaggttattgtgagattaaaggatgtaatatatgtgaactagtaatatgcaaactttacaaatgtaagattcagtattattttactttctatcaatttaatgtattttaaagtagtcatcatcttttcccaatgtattatttattccacatatttgaagcaccatatcatatcacacttatccttaattgtcttcaggtttgcagtatttaaattaaatcactaattcaaattgaaaaatgagaggaactattagtttgtagaaatgtacttattactagattaaagtgtggcaattccagttttttcacgatcaagtgactatgtggtataatatgttttcatcaaaaggctgcatgttattatgaatttttaaaagagtgtgatagtcggctccttttttaaatttaattttaattgaaattaattttaattttaattttaatttaatttaatttaattccaaaatattttctttaaataaaatttgacatcatcatagaaaattatatgatatcaacaaacttcttttctatggtaatattactgtatggtaagtttatatctcattatttctgtgattgctatctgcgctttattttattttctcaagaaaattgaccattttcactaataatataatttactttaagtaaaggataggctctgcatatattaacagagttgtttgagttccagctttcattgaaatgatttcctgagaattgattgcatgccggatgctaatctttactacaatagctgaaaattcacatttcaatatatctaacagcaaatgatcagactgctacccagacagtgtgattcatctatagccatgttaggctgaaagtataaataaatcaataacacacactggtgataaggaaatgttctcaaaagtacatgaaagaaaacaagattatttcataaacaagtctatatattcacaacaaaggagaaagtagaagtttagattattataataaaaaaggcatctgctttatgtataattaaatagtttttctatgagtctgtaaaaacttttacacgaataattgccttatttttcctttgtagttatgattacttaaatatcaatttattaaatgcctgtcctgtgccacacctatattcagtgttagaaagatgaatgagggattataactgaacttaagggtgagataaagctgtgggcaaatatttccagtaaaatgtttgggtgttacgtaatactggaaatctgtttaagacaagaagtataacagcggaaagatggactttctgtggtggaggctttacaaaggaagtagagctttagtagggttttcaagaataaatagaaagtgtgaaatgacaaaggatgggccagagacattccagattgaggcaacaatagtcttcacagtacagatgtggccagagtgctttctgctcggtatttgagaaatgtcttatttctctcttctatgattcaatttattggctgattattctgcccaagccaaaaaatatgtataacttctgtttatgttaatccttgtaaatccatctctaatgcacagagagctgcacgtggaagaaaatgtgttagatcagttttcagatttgactgtacaaaaacttgggttctaaagacatgtctgtggagctgtggaaggaaaagctgcatgaaggctttcctgattccctgcttcaaccagaacagtctcactttaaattggttttaatattgagatttctcatttggaataaacaaaaacattgaattgcaaaaagaaaatatgtttaactgaaatctcctatcaaagacagccttgtggtcgcttttcttgtttaatctcttgtagatgacagaaaaattgagagcttgtttatagacttgggaacacttaggctttgaaatccatatttacttacttgaaggtcagtcatttttgccccctgatgattttagaaaatgtcagggaaacaggcacagtaattgatcatattaggatggagtgaatccatgaagaattgacagcttgatctcgaaagctgtagtgtatgtatgaggatttgtagagaagtagaaaataagtaaaggcctggagaaagcagagtaaacatagagtagaacctgtacagagtcaaggactggtacactggtctcaattctactctttataaacaaaataaacaatggaaagttacggtttaattcctggattacatgatggttaaaatggaaggatagtttttaacaagaaggtacatttaaacaaacaaggactccagggtactcagattcttcatctgcctattttactgtctatttcatctatttctgggaacattatgtacagaaaatataagattaatccaattttagcatgtatcagaatcacctggtggatttgttaaaacatgaactggtaggccttgtccctggaatttctgattcagtaggtttggggtacgcgttaagtattggcatctctcgttaagcgccaggtgatgctgctagtcccagaactaactcagagaatcactgagataaacaaactgtataaataaattcctggaattgagtgtcttcttcaaataaaaacaaaataactcccatttttctgcccaaagagttgtgaaggcctttgttattgaaaacattaaatgaattgttaaaaaattaaaggtttaaacattttgcctaaatgaatattatagtgctggctacatttattttaatgcatttttggggatcgtacaacatctgctactggtatttcccacaaaatttgacctgtgtttcttcaactcttaggtttaccttagtctacaacttttgctttcacccgcccgtcatgtgaattttaaattttacattttgattttcaagttgaactttcatgttgaactgcttatgcttctcaaattgctcctttttctgcaatttaagtataatacaactggatgaaagaaggagtctcttacaaaatgtagctcatagctcataaagatatttgcaaactcaccttttttaagaaacaacaaatgtaggcttttcaataaaatacgtgaacttgagctctttataaaacaccacttgaagatcattgactttgaaacaaactaattttactttattgaatacctttttcccttcttcaaagatttccaatgctgtatattgattgttctgcccttttcaatgtcattttgtttttcttgctgcaaaaccatactctgagttacttaaattgtatttatcattcccagtattatttttttctttagcacaaacccaaacttattaagaatgctgtgatgttaatttcagaagaggatagcactaaaggcagaataattctgatatccaaatatttttataaataacatttgaaaaacagtatatattttggtttagtctactattaatagaggaaagttatagggaaacatattttgttctaataagaaagaatatctaaaaaaacagagcaggaaatcaattaaataatttgctgatactttcataaatgtcttcaaattatgttgtgattaatacttataagaactatttttcaggaggttccagaatagagtgagtgttcatctgagaactcatctgatccccttacagttctaacagggactttatatgctaatttttctcctaatgatggttttctatgtaatgtaacaagtcttaaagttttcttaaatattcatgtattaaagtgtataaaattccttggagtgttttattttagagactttttcattaatagatacaattttgttgattatagtttaaatggaagggatataagtcaaagaaatattattctcaatatgaattatgaaaggagaacaactttaaaaatacttcataatgaagtaagaaaaagagtacatgaaacatcttttgggtttaaagatatgaacaagtgatttctggtgatttttttctttttaattgcaagtctgtttggctatttctttggcttctgagcatctcttaagagagtgaatgaaaaggtaatcattaccctttagaggtaaaaaaagtctctgcaggtttcatagaatctatttgatttcaataagcattaaaatgtgttgtaattttgcagggtatctcattgaatgtagagccaagattgattctgttgagagctcaactagatgaaaaacgtagccagtatgaaacactcttaactggctcacatccttgcagtgggactatcacacacccaggcacccttacttgcggtaactggctactgattcagcaactgaatgagagaaaaagattcttaatgaacctggatcagagaccagattgctgaccagctcctggagttaataatccatcatatgaagtaaacacataaccatcactgaagttagagtaatgtaagcgttgcacctgacagcagtatggtgtagggagaatgagtgcagttattcctggcaggtttgtactggaatcttagcctagatctttactttgactttatgccaattatttaacttgcttttgtcactgaaaatagaaacacaatcaagacataatatctaccttccctcaaggaatttatggaaaacatagtcagttgttgatgctgtcaagttattgatattgtgataaatattatgcacaattacaatagaggtttgtagagctacggtaagaatagtatagtctgcccttggaagccacaggagggttgcctaatgaaagagatcagggaaagtttcctggaggatgggacatcttagctgaacatagtaggaaaagtagaagcaatagctctttagtaaatatgcattcagtgcttgtctcttacatgtcaaacactcagataataacaacataaatgaactgtttagtaggacaattccaatgcaatagaaaatcttactatgcatcttccttcagacgagaacatagatgtttagggaggtcttataagatcattccttgtacagtgccttgaagctgagtggggagtcaaagttaacatttatctaaccctgtgtagtgctctacagaatgttagaatagtagatttgaaagtcttttctattaagattatattgaagctttggaaatgaatgagaatgctaattgatcataggatgaaggggaaagaaatctgagcatatattataccagagggattcccttcccataggaagtaagaatatgaaaaaggagctcaaaaaataagtggaaaaactcgaaaaaggaagaatgttttcaaaagagcatagtcaataggagtagatagtccataagttaaaatggtaataaagttctgatggatttatccttttgcaatttactagttgtattcatccattctcatgttgctacaaataaccacctgagactgggtagttcaggaagaaaagaggtttcattgactcacagtttcacaggcttaacaggaatcatgactgtgaggcttcaggaaacttacaattcgggcagaaaatgaaggggaagcaagcatgtctcaccatagccaagcagaagagagagagagagagagagtgaaatggggcatgccaaacatttttaaaccatcagatcttgtgagaacttactcactatcatgagaaaaacaaggcggatatctgcccccatgttccagtcacctcccaccaggcctctcttgcaacacatggagattacaattcaacatgaaatttgggtggggacacagagccaaaccgtatctttctgccactgggtcctcttaaatctcatgtccttctcacatttcaaaaccaatcatgccttccaaacaatcccccagtgtcttaactcattccaggaataactcaaaagttcaagtccaaggcaaatcccttccacctaggagttacttctaagatacaatggaggtacaggcattgtgcaaatactcccattccaagtgggaggagacatggatctcctttgattccatgtctcacatccaggccacactgatacaagaagtgggctcccaacatcttgggctgctcttcccctgtggctctgcaggatacagccctttggctgctttcataggctggcaatgagtgcctgtggcttttccaggtgcatggtgcgtgctgttggtgggcctagcattctggggtctggaggacagtggtctttttctcacagctccaccaggcagtgccccagtggagactgtatgggtgttccagcctcacatttgccttctgcactgccttaggagaggttttccatgagggctccgcacatgcagcatacttctgcctggacatccaggcgtttccatatgtcatctgaaatccagacagaggttcccaaacttcatctcttgtcttctgcacacctgcaggcccaacaccatgtggaagccaccaagacttgaggcttgcaccctctgaaccaatgatctgagctgtacattggtttcttttagctatggataaaactggagtgctgggatgtagggtgccacgttccaaggctgcacagagcagctggcccttgggcctggcccaggaaacaaatttttacctgctaggcctctgggcctgtgatgggaggggctattgtgaagatctctgacatgccctgaagacatttttctccattgtcttggctgttaacatttggcttctcttcacttatgcaaagttctgcaggtagcttgaatttcttccaagaaaatgggtttttcttttctactatatggtcaggtcacaaatttcccaaacttttatgctctttttcccttttaaacagaagttctaatttcagaccatctctcaggaaggcatatgactgtatgctgttaggagcatccaggtcacatcttgaacgatttgctgcttagaagtttcttccaatagatatcctaaataatctctctcaagttgaaagtttcacagatccctagagcatagcacagtgctgccagtctctttgctaaaatatagcaagagtgacctttgctccagtaaccagtaagttcctcatttccacctgagatgacctcagcctggaattcattatctgcatcactatcacccttttggtggaaacaattaaacaagtatctgggaagttccaaactgtaccacatcttcctttcttcttctgacccctccaaattgctccagcttctgcctgtttcccagttccaaagtcacttccacattttcaggtatctttatagcagtctcccactctgctggtaccaattttctgtattagtttgttctcacactgctataaagatctacctgagactggataatttatgaagaaaagaggtttaattgaatcacagttccacaggcttaacacaaatcatgactggaagatgtcaggaaacttgcaattatagcagaaggtgaaggagaagcacacgtcttaccatggtggagtgcaagagagagagcaagggcgcagttttaaaccatcagaactcatgagaactcactatgatgaaaacaacaagaagaaaatccacacccatgatccagtcacctcccatcagacccattccccaacatggggggattacaatttgacatgagattaaggtggggacacagaaccaaaccatgtcactagtagtgcttggtataagaatattcattaggctgttgagtgttaaagcccagaaatgaggcattagtgggtgaatgttgaaagcgggagctgatgcagtaaatttagcccactcttgctaaaattgtcttggtggagctatagatggaggcagcaaggtataaaacaaatattcatttgtctgcttgtttgtttgaagactagagactttttaaggaattgcttctcttgttattgttaaaccattttgttataaattttatgagatctaatgggaatggtaatatacagcctagaatacgaatttcaaaattataaatataatgattgaatgttatgtatgaacactcagaagaattttgagttttgcccttcatgttaggaaaaggtgtaatttcacaatattcccttcaaagattaaaaagactgggtttagagtattgtattaccaagtggagggataatctttttttttccctttccttttgtgctgctcttccaagatggcattcagaatttgaatttcaccagtggacacttgttgattctaatagtccctttctttttttttttaaattttatttatttattattattatactttaagttttagggtacatgtgcacaatgtgcaggttagttacagatgtatacatgtgccatgctggtgcgctgcacccactaactcgtcatctagcattaggtatatctcccaatgctatccatcccccctccccccaccccacaacagtccccagagtgtgatgttcctcttcctgtgtccatgtgttctcattgttcaattcccacctatgagtcagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggattgctgggtcaaatggtatttctagttctagatcctggaggagtcgccacactgacttccacaatggttgaactagtttacagtcccaccaacagtgtaaaagtgttcgtatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttgttttgagaagtgtctgttcatgtccttcacccactttttgatggggttgtttgtttttttcttgtaaatttgtttaagttcattgtacattctggatattaaccctttgtcagatgagtagattgcaaaaatttcctcccattctgtaggttgcctgttcactctgatggtagtttcttttgctgtgaagaagctctttagtttaattagatcccatttgtcaattttgtcttttgttgccattgcttttggtattttagacatgaagtccttgcccatgcctatgtcctgaatggtaatgcctaggttttcttctagggtttttatggttttaggtttatcgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgcagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctgttttttggttccatatgaactttaaagtagttttttccaattctgtgaagaaagtaattggtagcttgatggggatggcattgaatctgtaaattaccttgggcagtatggccattttcacgctattgattcttcctacccatgagcatggaatgtccttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtgtcctgagactttgctaagttgcttatcagcttaaggagattttgggctgagacaatggggttttctagatatagaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgtcagttttcaaagggaatgcttccagtttttgcccattcagtatgatattggctgtgggtttgtcatagatagctcttattattttcaaatacatcccatcaatccctaatttattgagatttttagcatgaagcgttgttgaattttgtcaaaggccttttctgcatctattgagataatcatgtggtttttgtctttggttctgtttatatgctggattacttttattgatttgcatatattgaaccagccttgcatcccagggatgaagcccacttgatcatggtggataagctttttgatgtgctgctggatttggtttgccactattttattgaggatttttgcatcaatgttcatcaaggatattggtctaacattctcttttttggttgtttctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactttttttggtaggtaagctattgattattgccacaatttcagatcctgttattggtctattcagagattcagcttcttcctggtttagtcttgggagagtgtatgtgtcgaggaatttatctatttcttctagattttctagtttatttgtgtagagttgtttgtagtattctctgatggtagtttgtatttctgtgggatcggtggtgatatcccctttatcattttttattgcgactatttgattcttctctctttttttgtttattagtcttgctagcggtctgtcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgtcagggtgtcaattttggatctttcctgctttgtcttgtgggcatttagtgctataaatttccctctacacactgctttgaatgcgtcccagagattctggtatgttgtgtatttgttctcgttggtttcaaagaacatctttatttctgccttcatttcattatgtacccagtagtcattcaggagcaggttcttcagtttccatggagttgagcggttttgagtgagattcttaatcctgagttctagtttgattgcactgtggtctgagagatagtttgttataatttctgttcttttacatttgctgtggagagctttacttccaagtatgtggtcaattttggaatcggtgtggtgtggtgctgaaaaaatatatattctgttcatttggggtggagagttctgtagatgtctattaggtccacttggtgcagagttgagttcaattccttggtatccttgttgactttctgtctcgttgatctgtctaatgttgacagtggggtgttaaagtctctcattattaatgtgtgggagtctaagtctctttgtaggtcactcaggacttgctttatgaacatgggtgctcctgtattgggtgcatatatatttaggatagttagctcttcttgttgaattgatccctttaccattatttaatggccttctttgtctcttttgatctttgttggtttaaagtatgttttatcagagactaggattgcagcccctgcctttttttgttttccatttgcttggtagatcttcttccatcctttggttttgagcctatgtgtgtctctgcatgtgagatgggtttcctgaatacagcacactgataggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttgtccgcaaagtattttatttctccttcacttatgaagcttagtttggcttgatatgaaattctgggttgaaaattcttttctttaggaatgttgaatattggcccccactctcttctggcttgtagagtttctgcctagagatccgctgttagtctgatgggcttccctttgagggtaacctgacctttctctctggctgcccttaacattttttccttcatttcaactttggtgaatctgacaattatgtgtcttagagttgctcttctcgtggagtatctttgtggcattctctgtatttcctgaatctgaatgttggcctgccttgctaaattggggaaattctcctggataatatcctgcagagtattttccaacttggttccattctccccgtcactttcacgtacaccaatcagtcgtagatttggtcttttcccttagtcccatatttcttggaggctttgctcgtatctttttattcttttttctctaagcttcccttctcacttcatttcattcatttcatcttccatcactaataccctttcttccagttgatcgcgtcggctcctgaggcttctgcactcttcacgtagttctccagccttggttttcagctccatcagctcctttaagcacttctctgtattggttattctagttatacattcttctaaatttttttcaaagttttcaacttctttgcctctgctttgaatgtcctcccatagctcggagaaatttgatcgtctgaagccttcttctctcagcttgtcaaagtcattctccgtccagctttgttccattgctggtgaggaactgcgttcctttggaggaggagagacgctctgctttttagagtttccagtttttctgctctggtttttccccatctttgtggttttatctacttttggtctttgatgatggtgatctacaggtgggtttttggtgtggatgtcctttctgtttgttagttttccttttaacagacacaaccctcagctgcaggtctgttggagtacccggccctgtgaagtgtcagtctgcccctgctggggggtgcctcccagttaggcttctcgggggtcaggggtcagggacccacttgaggaggcagtctgcccgttctcagatctccagctgcgtgctgggagaaccactgctctcttcaaagctgtcagacagggacatttacgtctgcagaggttactgctgtctttttgtttgtctgtgccctgcccccagaggtggagcctacagaggcaggcaggcctccttgagctgtggtgggctccacccagttcagttggagcttcccggctgctttgtttacctaagcaagcctgggcaatggcgggcgcccctcccccagcctcactgccaccttgcagtttgatctcagactgctgtgctatcaatcagcgagactctgtgggcataggaccctctgagccatgtgcgggatataatctcctggtgtgctgttttttaagccctttggaaaagtgcagtattagggtgggagtgacctgattttccaggtgccgtctgtcacccctttctttgactaggaaagggaactccctgaccccttgcacttcctgagtgaggcaatgcctcgccctgcttcggctcgcgcacagtgcgcgcacccactgacctgcacccactgtctggcacttcctattgagatgaacctggtacctcagatggaaatgcagaaatcactggtcttctgcatctctcaccctgggagctgtagactggagctgttcctattcggccatcttctaatagtctctttccagtgctatctctgtgtctagctaagaaaataggtctcttcctagaaaattgcttttaatgaaggagaggtatgaggtaaaagtagggacattttgctgtcaggcagagcttgagttggatgtataaaaaaagagctggaatagtttttcccttattgccactttccatttacatttgttcccaccattcaattattctttttaaaaaggctagaggaagtgatggaaaaactgaagataataaagacacaaaatgctgaggatggatatttgtgaaaatacataatagcaaccaattgtggggcaggagggaagtcagagaacgctggggtctgtctctcctactctgccacagcatttttgaagcagcatttagtaatttctgcacagggggtgccatacttagacaactccttatgatttttcaatttctcattatcttcaagaagtgttccagaaaagaatctagaaggaacactatcaaagataatgggttacagttttccacaatgggtaaatagcctgagttttcagattaaagaatcacactgaatattgagtgatgatgtggtttggctgtgtacccacccaaatctcatcttgaatccccgtgtgttgtgggaggttcctggtgggaagtaattaagttgtgggggcaggtctttccgatgctgttctcatgatagtgaataagtctcacaagatatgatggttttatacaggggagtttccctgcacaagctctcttctcttgtctgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccatttcagactttgctaagctagtcttcctgagaaatgtcctaatttttactcaccaattgtctgtggatacctctgttttgcacaccatggtcaattcatattcatttaaatatatttaataatttgatttataatgtgtttcttatgcatttaaatatatttaataatttgatttttaatgtgtatctcttatataataatgattttgagcataataaaatagattactctttctttcttgttccaacatttgattcttgcattagctacaaaaagttagttgagattatttctcagcaatgtagagctactttgctgaaagactgctgtatctttttaaaaacttaatccaaagaaaccaatagatcataagaaataaccaaatataaagtatctgtctaaccaatagacaaacctaattagaatactgcctgcatgcttatgtaagtgttggcattcagaaaacaataccccaaagtatgttgctttggcatgctgagcagtttaaactaaaagagattgaagtcacctcagatataaaatctttctcccatctcctgctctcctgtcttctgctcctctttctccctcaaagaaagtcatagaaaccagagttcctcttatgcaaggtgaggcataaaaactagaacccagtccaggcaggttggctcacacctgtaatcccagaacttggggaggtcaagatgggaagatcactggagactaggagttcaaggctgcagtgagctatgatcacatgactgcactccagcctagataacagagcaagatcctgtctcagaaaagcagaagcagaagcagaagaaggagaaggagaagaagaagaagaagaaggagaagaagaagaggaggaagaagaagaaggaagaagaaggaagaagaaggaagaagaagaagaagaggaaaagaagaagaagaaggaagaagaggaagaagaagaaagaagaagaaggaagaagaagaggaagaagaagaagaagaggaagaggaggaaaaggaagaaggaggaagaagaagtgaaggaagaagaagaggaagaagaaagaaggaagaagaagaaggaagaagaagaagaaggaagaagaagaggaagaagaagaaaaagaaagaagaaagaagaagaagaagaagaagaagaagagaagaaggaagaaagaagaaaagaagaacctgcaactcttctgccccaaagcaagtggtgaaacatagaaaggtcactggtatggtttggctcttttctccacccaaatctcatcttgaattttactcccgtaattcccacatattgtgggagggacccagtgggagataatttgaatcctggtggtggtttcccccatactattcttgtggtagtgaataagtctcataagatctgataggttcatcagggatttttgttttgcatctttctcattttatcttgctgccaccatgtaagaagtgcctttcacctcctgccattattctgagatctccccagccgtctgtaactgtaagtccaattaaacctcttgttctccccattctcagttatgtctttatcagcaacatgaaaacggactaatacagtcactttctccattttcttgtctcccttgaggatcctcattccggaggggtcctgccccatacctgggaggaaggagtgctatacagagaggccaagatgaatctgaagagaggcctcactgagtccttcttcagtcgatcaccgttagaccaatcccttttgttcaatcatatttctgtctttcttttttttttttttttaaatcaagacagagtttcgctcttgtcgcccaggctggagtgcagtggcacaatcttgcctcactgcaacctctgcctcctgggttcaaacaattctcctgccccagcctcctgagtagctgggattacaggcgcccgccaccatgctcggctaattttttgtgtttttagtagagctggggttttaccatgttggccaggctgttcttgaactcctgacatcaggtaatcctcctgcctcagcttcccaaagtgctgggattataagcatgaaccaccacgcccagcctgtttaatcagatttctatagagctgtccattcttcactaaaccaaagcataaatgcaatttttcctgagtctttgagtttttatttctgacagcttccctgtcacataaaactttgatttgaaaaatttggtaagcttttatcttcctaatctgtcttttgctataagagtatgactgtgattcttatcatgggtgaggaaaggtatcacatctttccactcctacataaggtatgatatacattttcctctttggtaaacaaaatttccgaaagacaagcaaatggactgtaatgatattctatgactataccacttgggagcaaagttggccatataggaaaggctgaatattaggatttattaaatttatttttaagtgttttaattctgtggaataattggtgtttaggcaatttatataccttatattaatcactcataaatctcctagaaaattaattttattagacaaactttataaaggaggaaagagtaattaaaatactattaatgaaaaggatcaagtgaacaagataagcaaactttgtttcctctgccccaagtcaaactaaaatattctgtgttataaaaagagtataggggagggaaaattttctttatcttgtatccatattaggttcatcagggctctagacagagaaaaggcagattaacaagagaaaaataaacagaactttattgacacatgcatcactcttacctgtgagagcactcagtgatgcgagcactcagtgatgagtgatgatggttagaacctaagcttataaagcatcttagcaaaacaatcattgttgtgtagggaaatgacaagacaaaagaaaaggattttgagcttctaggggcagcatgttgtgggaaggcaaatatgtaaggaaactaaccatagataatggtcagttaataaagtttcttttgttgattcctctgctgctatctcaagttgataagggtctaaagttgtctcaagagattagcttctatccttcctggtagagagaggaggggggcgctgttacacatctgtctcttctttggcaaagaggaaggacagaggttttccttaaatatgctgcttctcaatttcattcctctcacaataatccttatgccaaagtggcatatttcgggggtgacatatattgttaccctttaataaattcatgctgcaatatgtttataataatcagtacatatttgttcattactttttaagtactcagtaaaaaaaaaaaaaactgtaagaatattaaaatatgaagggcaaaatgcctccctttaaagagtgctaaattcagctgtggagctaaacatatatatcttaagatatgtcagtatgtatctttcttttccgttttgaatgaaaaatttcaacatatgatgaagtagagagggatgagatgagatctctgcaggtcctgggtctgtggtgcttatgaacattttcctcctttgcctggcccttctgtgctctgaggagggggaggctgaccccttcacctgtgtttttcagcaccacccccacacttgtttctagcaatagaaggctccaatggagatgggggtgagggggcaagagaatccttagcgtgtttctccctctgtttcagagcttttagcttcaaacaacatgttaacatctggccttagttgctacaacaacttatttttagttttagttttcctttaacaattgaaaagaaattacagagatttactataaatttctcagtaggcatctggaaaaaaattaagatattgtcctcataaccaaactattattatcatatcaaagcaaagtagcaggatttcctttgaactctgttttagttttttaaaattcctaactctcctacaattctgtttataattgatatatttgaatcccagtctaaagaaagtaaagatcccagtcacattgaagtatattttatgcaattggtacattcttattttaaaataatgttattgtttatctgaaattcaaacttaattgggtatgtaatgtttttattcattagatttaggagtcatagccatgtttcacttggttattgtgcttttataggtcataggtaaaatacaagccctgggtcagtggctaaaggtaaatatgatgagctaatgaagctcacattataatttactggagctcacgttataattgatggtaataaacaggcaatacacaattaaatcaacaatatgttgataagtgctgtaaacagagaaaaaaaagtagatgtgacaatggtaaatgtgcactgggaggtcagggacaacttctctggtgaccaagtgacattgccctgacagctaacttacagaaagcacctacacatgtgcaaatattatgcttcaccttcaaaggttaaaaaatatatatgacgtaaagtttctatgaaagccaaattataggtcacatcactttttcattctcagaagaagcgattgaaaatgtaaaccccgtgaggtgggaatgcatgtagtctactcagcaaatgtaaaaaactgaatataagattttgatttgtagggtatcttgagtaaactagaagggtattttgagataaagtcaaagaggtagataggtgccatgttatttaaaggcttttatgacataaggtggaaattggattttattctacgcgtgctgagaagcttaaatataggagaattagatgaaactgattcctcttgcaggagagccacctggctgcagaagattgtcagagatcaagggtaggagccttgggctggttagcagggcatgattatagtaagtcaggtgagagatgtaggtggttcccaccagagttgtagcagtggagatagaagagggatggatttggaatgctgcttggacaaatacttcctggccctctagggtgattcaactagctctgcttgctttttctttatatttgcaaaagaattgtgagtgaacttgtatcacaacatctaaaatgctatattaactttcctgattatgttgtttttttctcctactagactataaaccccttgatgacaaaaatagtgtgcatttcacagcatcttgctcatattcagtgctcagtgcattctggagaggaagtaatttaatgagattttagtttacattccacaaagaatttccaatgaatgtggcttctacaatcctgttaattaaaaggattgcaacaatagtccaaaaaatacacatgatatgtaatctggctattatagaaactttaaacgctattcttttaactttgaaggttaagcttggttcaagagctgcctggaatcacagcaaaagtaataaaacacacaagtttttagcctctttaagggaaaatacatataacttctccaactttcctttaccaaatcatatgactgatattgaactattcttttctcctttgctgcttttgcaatcaaaaccactcccattatcttggtaaagaatgtattctatgattccttgactcctataagcttaatgacatcagcttttaaaatgttgacagaacaaacaaagtgcacacagctgcaacattccctctgcctgcagttaggtgcttttatgcttttactaaacacacacacacacaaacacacacacacacacacacactcatactcattctacttcatttcaatttgaactacatgtggcttactacgtctcagttaatggcaagcaacataacttgttggcttttataaaagttaattattacttgtatattaatttgtttaattttgtttgcccctaaacactctgagaaggaatcattgctattttgttagattttctgctacctctcacatgagcctgatacttggatttccattttttaatgaataagtaaccgatgtaatgaactaaataataaccttgttgaacctaatgttatgaagtcaagtgtgtttgtcacccaaagaattttaagtggctggatggtgagaagagtcccgttagagtaatgcccatgaattataacacccactagcagcaaaacaacacgtgcattctagagtggctcaacctaatgcgtgaggcatttgggaaactcttgagaacatactcacaaaagagtagtattcagtttatgattatttatcttagagcctctttgtgattacttatttggtaaatatatcaatttatagaattattcaacctggcttctctataattattaattcattatttagcattcccatttgttgtaaaatactctctactcttccctgaaactgagttattacgttaaggctcattgatattttattcctcataggcaggatcgtgagggcattaggaagaacttgggtatttctttgttagagatggacaaagtagttctatatacaacaaggttatttgctggacccagccctacattacattgtatgatttttgcctcgtcagctcttattacagtgactatccccttgtagagagatactcaagtattatttgttgtaacttgaatgaagaaacagcacttgagttggaaataggaaaaaggcaactcttcacagtttgtgtttatgtgcccagaaatgcttgttgactacacacaaacaccatgctgaaatataatcatccaacgaaataaagctaagctgagataattaccactgggatatttttagtcaataataattatatgttaaccaactggtattttctgccaaacgagagatggcatttctgttgatgacacgttgcatgtgttctttctacagctgtatcttcatgagtcaacaggctttctctaagtctctctgcaataggaattaacaatcagaccatcttgctcttttttttattgccctttttgctccacttgatgtaaacagggatactggccatttcttaaatgatttttatttttctactatttttctcagcataccaattttcccttcaatactcaagtttaacgttgagagagaaatgaattttgcccccctcaaagcctctgtttacatttagttaatgagataatttgtttaaaggctaaataccattactcatatgctaaagtttcacaccatgtagaaagtttatagaaacacattaaactgaatgccaaaactatctagacctcactaaaaattgggatctatgtgcctcattttagtgaagaagtttgaattaagagagatcacatcactctctctgacatccagggtgaagtctcagcattatggactccatcctcaccgtcatcttgtactagttaacttttccctaactggtaacctacacataagaatattgcactttttcattatgactgacagagatcctagtattggtgtatggagactattagataaaaatcttggcattaaaagcaggagaaggaatatggaaaaatgcagagctgtcaagaaggctaatgcatataggttttaagaaccacatgaaggtactacttttggaacacagtggaaatcaaatgcatgacttatcaacataatcatttttggatagtatgcactacttgaacatatttaactaatccaaagtcttccaaggcttggatatacactggtagaatgatgattaacaacaggacttatatctgtgctttcttatgactccaataaatatgaagtccttactactggacactgattgtgtaagcagtatagcacccatagagagtgatcacaatctgagatcattctatcttatggtagctaaaacagtgcacattcaaggatatatgagaatacactgagtaaataccagatgtagaaggaaaggattttgaagtagtatgtgaaatggctcacagcacatgagttggtgtcagacgaatctggatttgagacctgggtcctcatctgaataactctataatcgtcatcagctaagttctttaaagtacagtttccaaatttatacatctgaggtaccaatatccataacataaatataaaataaaaaagatgtttataatagtgttattttagcacatataaataagcatttattataattataaatatataaataatttgtccaagattcatttcattaaactgagaagagaaataacatattaaaaatatttatcccatttctccaaatcaatgggagaaaagtacaagatgagttgtgggggtggatagatgaggaaaagacaatgtctttacggtatttccagttcacttctttgtttgccttgctcagtgtaagtagatcttggggaattaaagagtcagctgatatgatgatttgtttgttaccagaacctcagcattctaaggagatatactattgacctagaagactggggcctgtgttctctcagtaaccacttgtattttccaggacaaataagttctcatcttctcatctgtataataaagagttggttcttatggtcattaaggtcccttttaggcacaactatttgctgatataataacgtcatcttcaatttacttattctctgttgtcgatgggaaatcaattcaaagtctcgtatttttatgctttttttttgattattttgttttcttccccccgcaaagcctgaaattaactggcacagctgtggaattagtaaaacctactgaggctctagtcgttggtgacctttagttttaataagctgtgctgggttttattgtctataactagtttcttttaagtagatatgttcactttgatatcatattaatagaaaactctctaaaatatcagccttaacataaattgttgaactgcattttagagttcttactttttcattttttaattcttatatttcacaaataaagatgtatgctttcattaaaacgtgtatacataattacactcatcctcttaatatcacatatatataactaatatttttaagagcataagtggaaaacatgcaaaaccaagtgaatataatttatataggatattatcttcacaataatattggattcaggacagatgattagatgagcaagatattatagtttatagatcggactgtatttaatatagtttgtattttaatttcagtgtctgtgatttaaattacaatgaattttttaaaattgcatataaatgcattgttttagacagattaattctttatattcatagtcatcattaaatgagtttttcagtatggtgaaaacattattttttctttctatgaagatctttgtgtaaagatttccttcagttttatttgaaagaatccattaccttcaaaatagtcatattattttttctttgccagtataagaaactaaagttattgttatgatttgcatatttatattgaattttcctttgtcatttatattatttctatttatttaaaaagtatatgtgaataggctgggtgcggtggctcatacctctaatcccagcacattgggaggctgaggtgggcagttcgcttgaggccaggagtttgagaccagcctggccaacatggtgaaactgcatctctactaagattacaaaaattagctggacatggtagtgcgtgcttgtgatcccagctgctcgggaggctgaggcatgagaatcgcttgaacccaagaggtggaggttgcaattagcggagattgtgccactgcactcaagcctgggtgacagaggaagactgtctcaaaaaaaaaaaaaaatctatatgtgaatagataagattaaataaaatatatctaatgctaataaatgaaactggtaaaaattgaacagcttatcaaagtctgaatgaccatcgaatgttttagtggtagactagaaactgaagccaccttccacttctgcagaaccatgacaaactgggatagaacccatggtcttttagcctttgaattccagttgctcttagaagttccatatcaggataaattgaggtatgaggagaaaggattgtattaaattcattaagggccaatacagttttctggctctgggaaccattgtgtattctcagagaagaagagagagagcattggaacttgttactttctctactacacagctcatagaaggcagaaatttatttgtttttgcataactacagaactcattaaagaggtagatcaaattttcagacttgatctgtctagggtggtttctaggagtggcaaattataagctggtataccaagcatgaattggagttggctaggccaagtaagggatggtgatacattagggtacttggacagatgaaatagcacatatggaggtccatagatgaaacaatgaagtgtaatctaggacctgaaagaactttgtagttagttgaatgtatacattgaggtcattatataggggagatgaagattggtgccatgaagtgagataaaaattatgcagagattgaattatgcagtttcatcagagattggaaaattatgcagagattgaattatgccgttcatcaaatatataaagaaatttggaatcgattctaaaaactaggaggatacaacaaagtgttttaagtgagactgatgtaatcagattttcatttttttaaacttggatttgaaactagtagagccttagtgtcttagatcctcttaacaatgaaggacaacagtttattcacagacattttaaataagaatgcagatccccaaagaattgaaatgacttacatcacattcctcctaaaaatgtcagtaaaaagattgataaagcccaggtttctgttcttggaggtattcttttgagaatgtgagagatgttaaaattcttttttttaattagaaaatcacattctattataggctgctacatgtaatcaacctcaccaaaaaaaaaaaaaagaaaaaaaaagaaagggaaagcattactgaatgctacctgtcccaaacattagtgaaactgatggataacattttttaaaagtatttatcccagcataatacaattttctattatgagagcgaggtatagaattaaagcaactatcaaaatagcccatatcagatgcaatctttaccctgaataacaagactattaaaggataggagtctaaccaaagggacttttaaaagtgtctgtcatttgctgatggtggcacagattttattactctacaggtcagagggccacgtatttctctgtttatagtgaggtgggttttttttaatagtacatttatctttcttgaatatgggaaatccatacatagttactgtgttagaattcctcactaagaataattctcgataatcaacgctatcaggagttgagggtggcataagagagttcaagaataagatgataatttgatgatggaaaaataagtgagttctcctaatgcatacctcctatcattgtagacaaaagtttatgttctcaaagctgttttcacgtactacactcttcacctctatgtgatttgtttgctagagctgctgtaagaaaattccagagactgggtggcttaaatgaatgaaatgtattttctcatggtctgggtcccggaagtttatgatcagggtgctggcagcactggtgccctctgagcctgtcttcttggcttgcagacccccactcttctgcctctccccatggtcctgcctccgtgcatgtgcaccccagtatctctttttacgtgtataaatttcctcttcttataaggatgccagtcagactggattaatttccaccctaatgacctaattttaacttaatttctctttaaagattctgtctccaaacacagttacattttgaggcagtaggtttagagctttgacatgtgggtttcagaaggacacagttcatcccataataacctccaaagacgtcaatgctaaacagcctccatgagcttattaccaactcaaaaacatcgctttcttcccaggccttccctgtttgttttacttgactgattaatgtatgctgctctttgaagctcagtttctttctccagtgaagacctactgttttcccaccttcttctctaactcctactttgcactggtttacaactcagctcacaatattcccaagttactttatcagtaaaatgttttcaatagatgaaactcatagcaagtcaatacaccattttccacttaaatttgcattattttacattggattctaattgatccatacagctcgattgtctccccatctagtttgcagttgatgagaatgggaatgacacattatatttattttgtatcttcatatgtgttgctgtacatactatatacaatgatagagtgctgtgtatatattatattctcaaatgattcaatttgattcaatttctgatagtgaaatacccagctacctgattctgctggttttcaatgttactttaattggcgtgaatttccagcaattagctttccttcaccatacatactttataaccctctagactgctcaagttggctgggcctggtcttcctgacccagaccattggatgtttaagatcacattccaggcatgaggatggctgcacatctattacctcacagattgtcaagcttgattattactgatgtggatgattatctaggtgtccttatacctcagtgttccccctgtgccttttcaagaagagtattttacccagtacagaacttttttagaaatcaaggttatacaagcaactgtgctcatttgtgatcatcttgaaatccgtaaatactgtccgagtatattactatgttaggtgaaagatttgtgttgctctccacaaattatcaatgtttgtttacagaacatttgtgaaaaataatgtttggaaatgacttgctacgtgaagtaagtaaccagtaactcaagccatttctcccatgtggtctgttttaaaaatggaaattctgtaatctggcttcctcaccttggagtaatatacaaaatgtcaaaatgagaaaagggaccttggtagttgttgtgtctttcttgtttattctttcttgttaaatactcaaagaaagaaaaacagcatgcaatgtttgtagctcccattgtgttagctttttactgtcctgacatatgtcctaaagtttaaaaagcaataaaaggttgctgcttccacagtcattagctttcgttgctgcagtcaatcatccacagaggtcagagccgtatcagtttttcccatcctcattgcacaatccactctagccattgcactcatatatcattaaaggaaaaacgaaccaaggaaactaccgagactcaaaaatgaacttgcaatgtgaaaaatctcctatctccttatttgaggaaagatgctcctgtcacgctgagtaaacaataaaattataaggccaacactgtaaatggaagtattatcccatctattgatttataatgggttaattaattttcaagtgttcttatttgcaaaacatgatgtgaacattgacagaaatccttagatagtttaagatgaagtcacttttgtcttagtgacttgatcacttatacttaggccatagttaagaatctaataggattatttcagcagagtgttgccagattcatgtataaagtcaagaagtaaaagaaaaatataagttagtcatgtttgagttgggtgatgtaacctggaaacaaatctgactggactaataataacaagttaataaactcactgtgaacaaatcaattaaaaacctaggcattgttatatttatttgcatcttactgtctaactagactttagttgaaccacacttcatttcattttaattcaagcactcattgataatatattttgcatttcttagataatttcaaaaaaagatagtgtgccatagtcatattattataagggactagagttatattctaagtcttctgacattcaataaaattgttataattgggttagacatatatgaattacaaaacatgggtttgaaagtggtcacccaagcatgattaggaaaactgcatacaagtagtcttactaaatacaagttgtaccactccttgcttcatccctcagaaagaggcatgatgttgtcactgctgctcatcttcagcttccactttagtttctgactaattctgccctagcattttcttcctgtgcttttggctgtgattttccggttacttgaatttcttgtctgccttctttgagctagaattttcaggtttagtgtttgtattgttctgactttgtgtttgggaagactgctgccacaagtatgtcccggtgtatgtaattatattcttgaccaatgctccttgtctctgtccacataacctctgttgaatcccaaatgtgtacccttggcaagttgctgggtttagtgtgagagtcgatacggcaacatcacatagaaaaaatgttcacggccaatttctaatttgataatgtgatgaaatttatggatgctttcctcattaagatgttcatcacacaaacagctgcatataatttaaagacatattcatgcatatgaacttaaaaactcatggtttagaggtgtttttaatgcatttccctggagtttttcattgtatatgacttttttttttttccttcttttgtcccttggttatattaagctgcctcttaatacttagaaaagcagtgcttaagaaattggaatatctctttccataaatatgtgataaaatgtattgtaacttatatgatttattaaattgagtcacgcctgaagcaaatgcattattaagtagttaaaaaattcatgacatgtccttaacacactgagagtgccttagaggagttcattcatctgataaatatgtgtttaagaaaattgcttgaaatgaatctcttttatgagttttggtaattattgttcttatttaagacttagatatatatagcataaataacagaatgtgtttttcacatagggttgtggtttgtttttgaatgcaaatagtcagtcttttcttggtgggtatataataaaatgctttttttgcatcattaaaagttctcaatagtctatggtgtcctagaacatattatctacattgtatataactatgtttctgttttgagatttaaaggaacatatgcaatagcaactttatatgagatttgatttttcatatcagacttcagcctcaagcatttagttgaagaatgaagatcttaaattttgacttttctgtttttagccagacatgttcaaaataaaagtgctatttaaaaagaggtctgtttccatgtcatctgaaatagggatgttttaatttatgttatagtttgagatacaccaaatcaaaggaacaagcctgcctcaataacccagtataattttcctatggctgctgtcacatagagagcacacttttttttaagttacagctttccatccctttagcacttaatcatgtagagatttgtatcgttgattatgcataaaataatttgactaaatactctgaggcagtgtcggtgacattttgttgctgttggtaccacctcttgtttcattgctactactattagtaccatcatctttgataattactacaatttactgagtgctcgcattgtttctaacatgaagaaaagggctttattttaactatgttgcagataagaaactgagatctagtgattttaaataacacacacaaaagagaagtattgggtggataattatttctgtttctttttgtaatccatgtatgcaattcaacaacacacaataataatagtataaactatgatcaaaactcttgataggctttttataatgcgatcggacaacactatttaactttctcatttattatttatctaaactatttgaataatttcaaaatattctctgcttttcaggctacttgatttgcagcccaaataatctcaaaattgtaataagtcaaggaacatttttagcccgaattattaaaaaattgctttaattttgctttagaatcaactcctcactacccattgcattttagttttatgcgtttctttatcttctattgatggactttgtaatatattaatttatatgcttaaagtcccatttagctatagttttccttttgatttaaatgtaacttaaagagaggaaggaaaatttttatttcatcacaacttcttccaagtattttataaaaattctgatggttctctttactgaacttcttctaagtgtttcataaaaattctaatggttctctttactggcttgtattagcttgtactttctttgctgtaaggaaatatatgagatggggtcatttataaagaaaaaaaggtttaattggctcatggttctgcaggctgtacaggaagcatagcagcttctgcttctggggaggtctcatgaagcctccaatcatgatggaaggtaaaaacagagcaggacgtctcatatggctggagcaggagcaagagacggggaggggtgctacacacttttaaatgatatctcatggtaaatcactcattcactatcatgagaacagcaccaagaagatggtgctaagtcattcatgaagcaccacccccatgatccaatcacttcccaccacacgccgcctccagcactgggattacaatttgacatgagatttgggcaggaacacagatccaaaccatgtcatggctgaatttaccaaatcaactgtgaatggaaagaagtgaatgaatgctagcaagtaaatgtatttcagattaaatttttttagggaactagaagtaaattgccctgtttaaaaaatgaatttataatggacttctagctttggcagcatgaagatgttgtcacattctctccaaaaagcaagtacagatgcttctagacttacaatcatgatatctacccataagtaaaaaaaaaaaaaatcttcagttcaaatatgtttaatacccttatacccaccataatatcaaaagttgtaggttgagagactgtaagtccagatgcttcctgacttacgataggattacattcagataaacccactgtagagtgaaaatgtgtatgttgaaccctagtaactcagggaccatctgtgtgatattggaaaaaaatagaaacaacatttcaaggcacatatgtcaacaaaaagcagaaaacgagttaataaaatttacttttgaaataaatgcaagagttgcaagttagaggagtatctgtggccttctttccaggtcgctgccatcttcactccccacgtcaatagagtcagcaagaatagtatttgtaacagcgggcattgaaaaccaacagtttcgaggctatgcatggggaacttcctcagtttggagtagcaagtgaaaacctatggctttgccagctaaaagtgagtacttaggtgggaacaactgagcaaaacatttgtgttagcacacagaggtcctggttgggggagcaatggaccagcaagaaagttagccaagagattctgaaaatgagcgagccatagaaggtctgagataaggtctcgcatatcactggctattagggaggcctgagagggatttgagaaacagaagctgaggaagacttgaggactcacttcaactttaagtgtgttttccaaaccactcactaataaatgtgaagtgggtagacaccttatggaaacaaagcctttgagtacatcctctatccaaataactgggtgatcactaaactatgaagacatgctggagggccaggctcattcctataatccctgagctttgggaggccaaactgggaggatcatttgaggccaggagtttgagaccagcctgggtaacatagagaagtctttccctgcaaaaacatttttttaaaatgtatctgggctagtggtgtgtgcctgtagtcctaattacttgggaggttgaagtgggaaggtcacttgagctcaggaatttgagattacggtgagctgtgatcaagctatcacactccagtccgggcgacattgtgacaccctgcctgtaaaaataaatgaatagataaatagacgcagggcagtattcctagaaaacaaggcataaaaatacaatagtaatggtaaaatacaattaagtagagtatcagtggctgggctacacatcaaagctaattttaacacacatacacagaaatataaactgcattccagagttggtatgatgcattttctaatatattaaattttcaaccacaaattatgtgatatccgaagaaacatgaaagtgtgaccaatactcaaaagagtattgagtcaatagatattgacactacatgggaccagatattggatttagcagaaaaaaaaaaattcaaaacatctactataaatattttcaaaatattgaaggagtgacatcagcaaaatggcggagtaggattcttgggcttcactctccctatagaaatccaatagcaacacaggaagtataccatcctaaatgtcccagaactcaggagtgaggctaagacttcccttggacccttggacttcaggacaaagaaaaatggaaatcaaatattaagacttcagatgtttcacctcgttgccctttctctaggccaacacagtaccatacacagagaattctcctggacccacagtttctacagttgggaaagttagttggaagcaaatcttcagttttcccaccattcaggcactctttacagaaggctcattcctattttgtcccacaggaaacattgggattacaagcaggggtggaccacctggggtcagttggcaaaaaagagcatttaggagcagctttaaaaaagaatagacaaacctttaactagacttactaattacaaaagagaggttattcagtaaacaaatcagaaatgcaaggcgaggcatcacaatttacaccactaaaatacgaagaatcataagaaactattattaacaattacacaccagtacattggataacttagaagaaatggataaattcctagacacatgaaagctttgaaaacaaacacaaagaaatagaaaactcaatagagcaataatgaacacagagactgaatcagtttaaaaaaaaaaaaaagtcttccactgaggaaaagcgcaggactggacggcttcactgctacattctactaaacatttaaagaagagataataccaattctcaaaccattcaaaaaaactgaagtataaacaatgcttccaaactcattttatatcccaaactcattaccacaacaccaaaggcagacaaggacactacaaggaaaaaaaaaaaaatatatatatatatatatatatgtgtgtgtgtgtgtgtatatatatatgtatatatatgtgtgtatatatatatgtatatatatatgtgtgtgtgtatatatatatatatgtatatatatatggcaacatcattgataaagatacattttttaaatcctcaacgaaactattagcaaacccagttcaagaacacattaaaagaatcatttttcacaatcaagtgagagttattcttaggatgcaaagatggttcaaaatatgcagatcaataaatgtgatgcaccactttaacaaaatgaaaaaaaatgagaagatgcagaaaaagcatttaagaaaactcagcacccttttcttataaaaattctcaacaattaactatacggaaaaaatgtacttcagcacaatatatgacaaacacatagctagtattattcttaacagtggctagttgaaagcatttcctgtaagatcagggacaagacaacgatgctcactgtcactacttctctctttctttctttccttcttttttttttttttttttttttttttttttttttttgatacagagtctcactctgttgcccaggctggaattcagtggcataatctcagcttactgcaacctccgcctcccaggttccagcgattctcctgcctcagcctccagagtagctgggactacaggcacctgccataacacccagctaatttttgtattttcagtagagatagggtttcactgtgttgcccattctggcctctaactcctaacctcaagtgatccatccacctgcttcagcctcccaaagtgctgagattataggcatgagccaccgtgcctggccacaccacttctctttgataaagtactagaaatcagagccagagcagttaggcaataaaacaaaataaaaggcatactaataggagagaaaaaagtgaaattgtttctctttgttgataagatgatcttatgtgtaaaacaccttaaagacatcataaaaaaactattagaactgatcaatgaatgcactagagttgcaacattcaaaattaatgtgcaaaaatcagtagcttttctatattgcaataatggtctatcttaaaaggaaattttttaaaaaatctcatttacaatagcaataaaaaagttaaatatataggtgtaaatttaactgtaaaatacctgagtattagaccattcccacattgctataaaaatatattagactaggtaatttataaagaaaagaggtttaatgggttcacgcttctacaggctgtacgtaaagcatgatgctggcatctgcttgcttttggggaggcctcagaaaacttacaatcatggtggaaggcaaagggggagcaagaatgtcacatgatcaaagcagcagaagtgggaggtaccacatacttttaaatgaccacatctcataaaaacactcactattgcaaggacagtataaacaggatggtcctactcatgagaaatctgttcccataattcaatcacctctaaccaggccccatctccaacactggggactacagttcaacaggagatttaggtggggacaacatccaaactatatcaacttatatactgaaaactataaacattgaggaaagaaattcagggtaatacaaatcaatggaaagatatgccatgttcatggattagaaaaattgatattgtgaaaatgtttatgctacctgtcttcatctgttctgtgttgctattataggatacctgagactgggtaatctattttaaaaaaaaagacgtttattttggctcagcattgtggaggctggaaagtgcaacattgggaagccacatttgatcagcatctgatgagggccttttacttcatcatgacatggaagagaaatggaaggggaaggaggcacacaaaagaaaggccaaattggagaggcaacttcactttataacaatccattctttcaagaattattccattcctaaaataatcaacccaatctcaaaagacatgaatccatcttaatgacctattttccttttaaaggcagtacctcccaacagtgccacattggggaacatggttcaacatgagttttggtagaaataaaccacattcaaatcacagcattctatccctggctccccctataactcatgtactcacaatgaaaaatgttttcaacccatttcaatagtacccaaatcttaacttattctagcactaaggcaaaagtctaaagtccaaagcttcatctgggactcaaggcaaagtccttccagctataagcctgtaaaataaaaaataaatgtattttctaaatacaatggtggaacaggcataagatgagtattctccttccaaaagggagagagaggcaaaaagaaaaatcagcccaaagtaagcctgaagcccagcagggtagacattaaatcttaaagctcagaatattcttgtacttcatgtaccttttcctgggcacactggggtagaggaggggcttcaagacctcggacaggcccacctccaagactttgctgggtgtagcccgtgtggctactgtcatggattggggttgcatgctggtgcctgcagatttcctaggctggtgtcgcatgttgctgatgacttctgtgggtctggagtccagagggaagtggccctgctcccatggttccactgggcattctagagaagactctctgtgctgactctgccactgtgacagatttctgcctgagctcctaggcagtttgacaaaaactttgaaatctagttggaggctgctgcacctcctccactcttgcattctgcctgcatgcggaattagcaccatatggatgtggatattgccaaggcttacgacttttgccttttgaagctgcggcatgagctgtacctgggatcccttgaaccatggctggaacagccagagcagctgggatgcatggagcagagaatcctgaggagtgtgcttgaggcctatcccccacaacattccacccttggagacctctgggcctaagataggagaaacagcctggaagatctttgaaatgcctttggggtctttttcccactgtcctgataaatggcctctggctttgttctcttcacactaatctatttagtgaagagttgctgtaccgcacccttggcttttcttctgaaaacagttttattctctaccacatggtcaagcaataaattgaccaaatcttttcactctacttcccttctttctagcagttcactagcagttagaagtaaccaggcagcagcctgaacatttgctgcttagatatgtctacaaagccctaggacagggacacaatatgatcaagttctctgctaatgtctaacaaagatggcctttacaccagttcccagtaagatagtcctatttccatctgaggtctcatctgaatggcttttactgttaatatttctgtcagcattctggtcatgacaactgaaccaatctctaagaagttttaaacatttttttagtcttttttgtcttcttttgagccctcattatattatccttaatgctccacatacagaaatactatttataatagaatattattctacttaaatgataggtaagggaggtgatggatatggtaactaacttgtttaaaagagaaagatatgactatgtgctgtctataagagatgagactaactttagattgaaatataaaaataggttataagtaacttgatttaaaaatctgtaccatacaaacataaccataagagagttagagaggctatattaaaatcagacaaaaacatattttaaactaaggtatattactagttataaagagggatcttttaattaaaaaaaggtcaacacggaaggaaaagataacaattataaaggtacttaacactagagctttacaatatatgaagtaaaatctgacaaaattgaaaaaacagaaatggacatttcaacaaatataattgtgatttcaacacccttttcttaattgatagagaaagaacagactaaataagtaaagatacaacaaacatgaaaaatactattgttgtagaaaaaaccgggttcttgtcacacgaccagaaaatattaggcatgcagacactttgaagagtgacggggagtggaatttattggatgaaaataaaaaaaaccctgtcagcaaagcgagaggggttcctgttaacaggtctcaacctcacagatcgaatcccaggtcaccacccaggaacagaagaggccaggctccttcgccctggaaacagggcgaacttcctgagcctctaccctgtctctgcagtgcgcaggtgggcattattcagaaataatcagtcaggaaaagggaaggcttcatctgggacaggcagcctggtttctcagccttcaggctgtttcagccttcagcctcaggcggggttttgccaggggacccttggctgcctcctgtctctatcattccccctcgaaaggagcacatctaactgcccttagaataaggataaggataaacacgaagaccaatcttaactgcttcctgaagacagagggggctgctttggggaaatggcagtcagatctccctcagaggccaatctaagcgttcctggcaaaaggggccattgtccaaggctctgtttgcatgaccatttggagtctgctggcctgaaggagagaagggacaaaccaggttattagaaaacatgtatccaaatgaaacaaggggtgggtgaggacagctcaaaaacccgaggtcttttacgggtgtgtacatggagagggaggctgaaagcccactggaaaaaaaaaaatacttttacctttttgccagcgtgttaggcttctgggtccccttcccctgagcccagtcctaagccaaccagtttaaggtttgtgaaattaactcttcccagtttggaggatgcatatgacgggagcgtcccagagtatggacacacaattacctatcagtgaagagaggacagaggaggaaaaaggaaaaaaaaagtagtcattttttttcaaaggattcctagggatttaggatgcattcaaaaggggtacagactgaagatgaatggctactcatctagaatgaggagagcaagcgtccctgattcctttctctttctagcaaatacatgcggtacgtgagggagggaaaatgaagcattcctctttctttcccccattcttgtatctcccagtctcggtgaccacgacagggtgccatccatgggtgttaaagtggctttcaaccatgttcacaaggggacttaggtgataggagtatctgctcttacccacatatgccccatctcccctgctgtcagtaaactttgacaggaacaggaactttcccaggaacaggagaggccaggctcctccgccctgcaaatggtacagacttcctgaggctccaccccaatctcccagtgcgcaggcgggcattattcagaaagaatcagctgggaaaagggcaggcttcatctgggatgggcagcccagtttttcagccttcaggctgttttagtcttgaaggtgggcttttgctgggggacctttggctgcctcctgtctctgtcactatcaaccaactggatctagttgacatctataaaatattttacacaactgtaaaatatacattactttcaggcatacgtgtaacactctcaaagggaccatatgctaagcattaacaaatgtctcaatatacatgaaaggactgaaatcatataaagtatattctctgatcccaatacaattctattaggaatcaacaacaaaatgaatagttggaacatcttcaaaatttgaaaattaatcataaagttataagcccattggtctaagacaaccttttgagagatattaaaaaaatcatatgaataaagatggaaacacaaaattgaaaagctgatggaatgtgggtaagctagtgcttagtgagaactatagcttttagccttaattttaaaaaacataaaaaatttaatgttaagaatgtaagattctctccaaaaaactaaagacacacagatcaaatccaaagtaattagaagtaaataaatagtagatctctgagtgaaaagaatgaaaaagaaagtagaaaaggagaaaaacagtaactaaaatttgtccatttttaaagataaaggaaggaaaacaaaaaaaaatactgatagacttttaattagattgaccaagaaataatgagagaagaaacaaattatcaaattgggaatgtgaaaggattctcactatagaaactgtagaaatttataatgtaggactataaacggaacattatgaactactttattccaataactgtgaaaaacctaggtgaaatggataaatttgtgaaagacacaaattaccaaaacaaactcaacaaaaacagaaaatagtgagatctatatcaaaaaaatgaattattaggagacaaatgtgtaaaactgacaaaatttttgaagtcactttactaaagatcacatatgaacagcatatacaaatggccaacaaaagtgaaaattgcccaacatcactaatgattagggaaatgcaaagcaaaaccacatgcgataccaacttacttctgcaagaatgaccataatttaaaaattaaaaaataatagacattggcatagatcttgtgaatcaggaacgcttttacactgctagtggaaatgtaaactactataaccactacggaaaacagtatagagattctttaaagaactaaaaatagatctaccatttgatccagcaatcccactattgcatatctatcaagaggaaaaaccgtcattaaatgaaaaacacacatgcatgcacatgtttatagcagcacaatttgcaattgcaaaaatgtggaaccaccctaaatgtccttcgaccaacaagtggataaagaaatgtggtatgtgtatataccatggaatactactaagccataaaaagaaacaaaataataacattcacagcaacctggatggaaatgaagaccactattctaagtgaagtaactcgggattggaaaactcaacatcgtgtgttctcacatataagcaggagctaatctatgaggatacaaaggcataagaacgatataatgttttgggttttacatttaagtcttcaattcatcttgagttaatttttgtataaggtgtaaggaaggaatccagtttcaattttctgcatatagctagccagatctcccagccccattgattaaatagggaatctgtgtatatatccaaaggaatataaattattctgttataaagatacgtgcatgcatatgttcattgcagcactactcacaatagcaaagacatgaaatcaactcaaatgcccatcaatgatagactggattaagaaaacgtaatacatatacatcatagaatactatgcacccataaaaaggaatgagatcgcgccctttgcagggacacggatggagctggaagccattattctcagcagactaatgcaggaacaaaaaccaagcacccatgttctcagttataagtgggagctgaacgataagaacacatggacacagggaggggaacaacacacactggggcctgtttaggtgtgaaggggagagcatgaggaagaacacctaatggatgttgggctgaatacctagatgatgagttgatctatgcagcaaaccaccatggcacacgttaacctgtgtaacaaacctgcacatgcacctggcacttaaaagctgaaggaaaaagacaaaaagaatgatataatggactgaggactggagaagtgtgggaggaaggtgagggataaaagactacacattgggtgcagtttacactgctcaagtgatgtgtgcaccaaaatctcctaaatcaccactaaacaacttatccatgtaaccaaaaccacctgttccctaaaatctatttaaataataataattaaaatcacataattcttatagtaatttaaacatcattttaatagttctatatcacttgtattgatattttgatataaaattagactaatttgtctttcattttttaatgttttcacttcttttttagttacattttttaatttgtaaaacttttctgtggttaaaatatcaagagccgtagtatgaaaaataaatatacatagaaaagacttactttaggggctgggcgcagtagctcatgcctgtaatcccagcactttgggaggccgaggtggtgggtggattatgagatcaggggttcgagaccagcctggccagcatggtgaaaccctgtctctactaaaaatataaaacattagccgggcatggtggcgcatgcctgtagtctcagctacttgggaggctgagacaggagaattgcttgaaccgggcaggcggaggttgcagtgagccgagattgctccactgcacttcagtctgggcaacagagtgagactccgtctcaaaaaaaaaggagagaaaaaaaagaaaacactcactttaattctgtccattgttgaatgatggctgctcaaaattgtagaacaactggtttattgggaaaaaaaattgtctgtatttgcatcttggtcaaggactatattaccttgataaagtcttagtaaagtattgaaagggggagggaaaattggggtatttatgaagctttggaatatgatttaaagaagttcttttatgagagagtttcattacggagaagcaaggattttaatgatttacatttggttgaggtggcaaggtgaacattttgagaagccttagaaagacttggggagtaagctgtcattttatgccttctattgaagagctgaacaatttgctctttattgaaataagattttcagaaagttcctggaatgaaaagttatttgcaactattatcttcttgggcaagtttcctgcgattataaagtcatgttgacacacatgtagtggaatggttaaatcatgaaaatgtggacagtatgctgtgtgggggtggatggttttggttctcatgttccaccatgattctctctgttccttaacagtgtaatttttgctagtttattcattttccatctggtgtttactttttaagaaagcaattgcaggtatagccattgcttttcagacatttattaatgcttaccacacatttacaggaacaactactgtgaaccatgcatggtgctaggttttaaagattaaaatgatttaaggggaaatgagattttcctccaaaataaaaaaacttactctaacttccagatttaattgctaagcacacataattgcacctaaaacaggttgatgagggattgatgagggagagtatagagaagcgcctgtgtggcaactctgttcacatttaattaactgtctatagatggctgctaccagcattgatcaaatgactacctatacatattttactcttacacaggaaaaaattaaattggatcatgatataatatttatataactttttaccacccatgttttaagatataaattctagattaatggagaatacatcaattttaggcaattttactaagaagagcagatattgaagaacaaaaagaaacactctgtaaatacaggtgtctactcgaaggttcatcgaaatttaaatttgttgtgaattcttcacaatgagacttttcattttcattagaattcttgcagcattattattccaggattggaatacagttgcatatgataatctttgtttcctttataataactatgagtgactcagttaggaattcaccttggcacaggactaagttatttctgatctactcaatggagtgtatgtatttaggattattcatccttgtttacttaatgtggttttcttcacacattgttttttagatgtcgtttgagagaaacaaaacctttaactcttactgagagggaagatgaattttctaaccctgggatttggctgctcactgagtgtacacataatagatgggtgcttccattgtattattaggggcattcagtagagggcctctcatctaccagggcacaattgagtattcctgattattgatttgtttatttgtgtttatatatttgtaattcccctttaaatactaatattatcaagtgttctaccacatgtgatttccctgttctgagctgtctaacattaagtataatggccaaaccccattttctgtgggatttgggattcttgacctaaggaccacccagcaccatgcccctgagacctcccatcctgaacacagctaatcggactggagaagtccatctgaggaagaggaagcagttgtcttctgtagtctgaccaggagattagcaagaagtctggcccaaaaactctgccccacaggtttctctaccaaatggtgaaggccaggtgttcagttactttttcctaaggtgttgaaacgtaaagcatgtggaaaacatgcaaatagaaacagcaaaatggaagcaaacagagaccatgaatcagtaaaatccatgaaattaagggaagtgaaaatcaaagtcggaaaatagtggcagccgctccacagtagtggagcatgagggtaggttatcttcaagtagtgaggtttgtgtaaattagatttctttatattttctctactttttaatgctctgcaatttaaaaaaatgttacttttgtcatcaggataatatgttcaaatttttaaaaagtacctaaaattttaaaaaatcactagcttgatttaactagattttcctttgtttatcatcatgactctgcaaaagctgcagcatctgctgctttatgaatgaagtgctgattaggcaagcaaaaatacagttttccagacctcacatttaggcaactgttaaaagcctagtttccgagtcaaagccagatataaatttctaccctgtgtctcaactcagggccagttatggatggtggagagtttgagatactagtggttaagtttaatttcagctgcctgtgtttgtaaccatttgactttatctaaggaaggcaattctacaccttctctcaataattttttttttccacttggttttctctgacataactgagatcattgacattctgactagagcctaagaaatttcatgtatgtgtctgattcagtggttcaaggccttaaagataagcctttaattctgaggaagagcctttagcttctcccgtctcttaatacaaacctgattcatgccaggtttgtctaggggctacgtggatggttaataaaaacatgtaatttctatcccccaaattgtacctatttaggattagatttcagaatcttatttgaaacttaaacaggctttagaaataattttgtcccactctattattatagagatgaataaatgtactttcaaggcaagtagagcgacttgccaagattacaaaaaaatgtctgcgacagagccgagtctagatgtttatcttctagtttccagccagatactagttttatggctagtttccgccatgctctgagggaggcacattttccatcatcttttatctcaacactgaatactgtttttgacacatagtaggaaatcaattaatactatttaaatgaatacaaatacatgatgtaaaatatatcagagaagtctattatgtgttttcagacaagcttttatttctacagtgtatatttttatgaaactgatatgtatttttttagactaatgtgcaccatcaaatagcactcatttttgaaacattttgagcgtgatatgtatgtaccatcaaacggaattgagtaatatctgaagttgtactgggcactctgccaagatttgtccaaagaaagtaatgtgaaattagctttgcctttctgaatatttacaaaatccaagcaaaaaaagaaaaatccaaagggaaaatgctgatctctggaatactttggacaattcatgcatcaaaagccaactgcagagccactatttgcaagtcaagtctcaagatggtatactatctccaggaaaaggcttggaaggtaagtaagcactactgttgaccccaatatctcaatttccacggagaaaccatatttgttaagatgcagagagatctctctaaagtgctattgccgagattaaatttgagccatctgaaggcttcgtcattatcttagatcttagccttacttgtgccttattctgttctttaactatcacttatgctgcaaactgtgatcctattgtgattttacccttactaggtggttttcctggtaagataagtatttgattctgctcaaatttctcctcttgccttcctaactggtctcaatctttctttctgcttagtatcattctgtctcagcacccgtttatctggctgcgctttggccagtttcattgtttatgattatttggttttggtgcctgcctatatgatcagttcaagtcctagccgtgctggaaaatttctggccccattacagaccagacatttccactcacagctgcttctgtatctatcacaagtatgcattcatgcccatgtgcatcaatcctatatcaatagttgtttctacagagatagcctctgaagtccatccttttgtatatggtcataggtaaactgaaaatgggaagtaacaaggtctctgttaattaaaaggtccattaagggctcaatgccaaaagttggatacgggaaagcttgccaagtgcacaaggttagaaacttaattgcacttctctttaccaagatttctatcaactgcagttctcaaatatatgaccttcctttaattttgtactgatgtataaaatgaggattttgcctgtttttgtacttgccatttggaggacatatatgcatgcctgccataagtggaatttacatatgtatatgtaaaactacgattcttggctttatatcagtggaaaaataaatcagattatgtagatagatctgtctttatacctgatttgcttttatatatatatatatatatatatatatatatatatgcacacacacacatacattcatatttattttaatgggcaaaatatttgagaatatttacatgaaattttttatgtagtaatctaattttggaattgcactatttcttttgtagaactccaaaaataatcagtacacaaatttgaaagcaaaacagtaaacttgaagtcatttttggttactctatcttctcagaatactgaggtaattagactacagggtgtccttcaatacttgaaattatattttgctgtttgcaattaagatgcactgcagaatatgttgtcatggaatggccaccccaatggctgtcaagcagacatttttcttagccaagtcacacaggtaagtaacaaggtagattcaaggttgataaaaagcaaaagcaaatccacacttattggtttcctggtgtgacattgagtatactttgggatttcacagaagggttagtcagagtattccttcctatattttgatcagttgctaatacaggtttgattcctctttcaagtagaaatgactcagctataaatttatagctgcctctgtaggtagttaatgcaggtggataagcaatattgacagcatgactaagtctagccaaagcaggtgcatgaaaaattattagtccattctgcaaaaccctaggccatctattctgtaggatttatctgtcttttccattcccggtatcaagttcttaactactaaattaagcttatactgaagaggaggagctaggaaaatcttccttagatattcagatactcaatattccattaatcgattaattaaacaagaaatcaattaaatcacaatttatttgtgcacttttcatgtgacaagcatttcgctggttctgatctcacaagagataaacataagaaaccatttctgcacactgagaactcaaaggtttttgtgggagtcagaccagttatgaggctgcgttccagtttcaaaaatagcagtttatataaagagattgaaatttctgagaagattaatagaattcagacctgagaagaccgctcaagtcaagggacagtgccagaagcgagcatacccctagctgtgttatcgctgcctggtgatatcctgtgggtctttttattttataatatttcagagatgtgttctgtaactcatatatagggagtcaaattctgttatttctattcatgcctggcatataagactgatatgatcttactgttagacttttcatgaagaatggatgttagattcaggtatatatttttgaagttaaatggcccttgttacagatgtaccagagctccccaatatagaagcagttcttccaatattaattactatgtgttgtatattacaagttgccaaggtaccaatagaaaacacacaaagtcactgaatggaaaccccccaaataatgtaaaaaatatcacctcttttagctcttagaaaatgatgtcgacttctttctaaaggatattgttactggagggatgaggaaaaaactcaatttggaggaaattagaaaataatttgcagtttagaagggggttatcttatatacatgttggtaataattcaacattaacaataaatgttataataacaacatagttatcatagtaaactattttataccaaagcagtagtcccagaacttaacacatactaacttttgattcttattacagtgctatgatgtaggtatgtatgtcaccccgctttagatataagaaaaaaagaggcaaaaggagaccaagtttttccaaaatcacagctggtaagtgtcaaagcctagatcaatctagatagcctggttccaggtgccttagtcttagtcttttcaactgtatgctgcctatgaatttatgatacctcacttcttctcctatgctgtgctcatggtagtttatgttaatttttcagttaaaacatttgtcttttccaagtgtgcggtcatgccattggtctatttttataccactacctttgaacttttctccgtctgatgtatttctcttatctacatgtgtagatcattacctccagaataatagttgtagcaatgggcattgttgccctaatgggaattcttcaattgtcttccccaatatgtgtgagttggctttgaggttaagctaaatatatcttacagagctaaggtttatgtaagaaatcaacttcagaaatccagctgaaagtcagtagtgtgaagagaggtagtcagaatgtaaatcatttcaaaggtagagttgagagcatttcttgatagattggatgtgatgtgtgcaagagaaacagaggattcaaggatgactcattttttgattgtcattgtttttggtctggccagctaaaaaggagaatgtattacctactaagatgtggaaggcctgggaggagcaagttttgaagaaaggtcgagaatttatttattgctgtatgtattaatcagggttcttcagataagtagaaccaatagggtagatacgcagtgagagaagtagtgaaaggtggagaaagagagtgaagagtgagagactgagagagagagagactgttttaaaaaatggcttaagggtttgttaggatgaacaaatctaaaatttgcagagcaagccaggtacattggctcacatctgtaattctagcactttgggaagctgaggcaggaggattgcttgagcccaggagctcagggccagtctaggcaacacagcaagacctcatctcatatttatttttttttaattagctgggcatggtggtgtgtgtctgtggtcccagctacttgggagtctgaggaaggaggatcacttgagcccaggaggttgaggctgcagtgagctctgatcacaaacactgcattccagcctgggtgacagagtgagatcctgtctcacacacacagaaaaaataattaattaattaatttaaaaaactaaaaagcataaacaattaaaaaataaagaataaaataaaatttacaaagcaggccaacaggttggaaattctgacaagagttcattttgtagtctgaaggcagtctgggggcaatattcactcctcttcagtgaacctcagtcttttgtattaaggccttctaatgattgtatgaagtctacaaacaatatgaagggtaatttgtttttaccaaagtctactgattgaaatgttaatgacatctaaaaagtacctttacagcaacatctagtgtttgaccaaacaactggatgccataacctagctaagtggacatgtaaattgaccatcacagcatagtaagttttggatgcctactagacatctaagataaaatttcaaatagcctgttaaatacacacatctaaatatcaagagaggaatccaggcaagagacatacattcttggattcatcagaacacagatgtcagtgaagccttggctcctggttccgcagactgtacaagaagcatggtgtcagtatctgcatctggtgaagtctcagaaagttttcagtcatggcagaaggaaaaggggagcaggcatgtcatacagcaagagagacagcaagagagagaggggagggaggtccaagattattttataacctgatttctaatgagctagtagaggggaggactcactctttactctttactgcagggaaggcaccaagccattcatgacccaaacacctcccacaaagccccacctccaacactggggatcacatttcaacatgagacttggaggggacaaaatatccaaccagtatcaaatgctttacccaatttagcacagtgcccaatttattaaagtaagttttcaaacacttctttaaaaataggtgatatctctctattcctgatgacttaaataagatgaatcaattttaccccaaaactgtgtatgctgcttgaatgctacagaaaagaaagaactaaaatatattttaaaaatatctaaaaccattaaaatgtctcctggtgatatttaaaattagaaatagggcactacttatttaagtagtatattaataatgtgggaattggttgaatctttacctcttgtggttctggaactttccccttgcaattgtatatatctgtagatgacttacattatccttaactgagggaaaaaatgtgttatggaagtatttttgattctggttaatgcactttatataaaatgccaaacgtaaattattagaggtaaagatgaggctttgaaatttttatgaaatatttcggtccagaacttggttaacccaaatcctgtcctgctgatcatgcattctccatctggagttcctgagaggctctacatctgagtatcagagtatcactttgataatcactatttaatgtcttacagtatagtacagacctttggacaaaggatgaggtggtacaaatggagtagacacaaggcctgatgagaactttttaatttattttccccttaatgtgtgtcttactactggtataaacaagcatgcttgcaggaaggagaaagagatggctaaaacaaaatcaatttatccattatggattagagtccatgtataacagagagaaagagctattttcactatagatagcttcagatttatggctcaaaaactatgctgctggattgtgtcaaacagtttagtaaaaatgaaatattattctctcatttggcataagacatcatgttgctcgggcacaatgagtgatcctaaaaatataatatggttatagcttctgttaatcaagaatgaggtaaccagcagcttctgaaaacaaagactggtaatgatggagatctcccttgagacataaatctcatctgtgatcaaaagaagagtagccttggctcctttctggggatccctggcagccatgatttttaagacacattaacaaacaactctgtggcagcaggaacttcctgggaagacaacagtagaaggaccagagtagaagatgggggaaaatatcgaatacctaagaacacagaggaaaatatcagatactcagaaaaatatccaatgactaagaaataactcagaagacagcaggatttcactagagtagatggggatagaatctagaaatacgtaattttattgttataagatatatttcgtaatctttctccctgaaattggaagcaatgcaaacacagggctgctgcagcctctattccagaaggcaacctttctaccctgtagtgtagtggccctatttttttttttttacttctctttttccccacctttctcaattgcttttaattcaccaattatatattaaatctctaccatatgttcagtgtcaaactatatgccagtgtaaataattggtattacccttcacacatggtatgtctaggtccagaaatatacaaatatatgagtaatatgaattgtttaatattataaaatcttcctcagctgccatgttcagtggttgtaaatatactgtggaactatgaatggaaaataggtggaaacaaataaatgtatgctcagcaaattaaaaaattctaaccatgttcttactgctaagaactttctacctgcatatattcctggagtgtcaaacctgaaaatgatcttctgcaacatcagtttatttatattaatttgtatctattagacttaggaaaatagtataaaaacaggaaggaattccatgagggactaaatgaaatataaattcgtaatattttttatacctataaaaatgaggccaggtgcagtggctcatgcctgtaactccagcactttgagaagccgaggcaggcggatcacgaagtcaagagattgagaccatcctggctaacatggtgaaaccctgtctctactaaatgtacaaaaattaactggcagtggtggcatgagcctttagtctcagctactcaggaggctgaggcaggagaatcgcttgaacccgggaagcagaggttgcagtgagccgagattgctccactgcactccagcctggcgacagagcaagactccatctcaaaaaaaaaaaaaaaaaaaaaaaaaaaagcaaggatgtcaaatttgggaactattttctatttgaaactttccttctgtctctaaacaagtttaaaagcagcacccccacctctcaaatgcccttaatagacaatgtaatataaataggtactacaactcactaggtttgattcctgtagaagatgaaaagtgactgctccacggcaagccactatgggagattctttaacaaactcaaatggattcgagagggaaaattgttgatgcaaagctgtttaatgagttctgttactgtgaagtgaaatcagtcctcccaaggatcattcactgtgagaggcagaatggaaacttcctaatgtcataaattgttataccgatatttatagcaaaggcaacatagaactctggagtttgaattagtttttttctctccaagaatacatttttagtattagctgtttgtttcaacctgggaagttttagaagttatttctatctgggcattttcttagcttgacagtttaggtaagaagtctgtgtggctatgccagtagcatatctctttgtgacaagaacatgcatcattctttggctgagcaaaagacaaaattatttactcaagataagcaaagattattggaaggctgaaattgcaaatgatgaaagttctacccatagattttgtttgcccatgactttcattctgtccttgcaaataaaagaataacttgatatatttcattgaataatcacattttatatttccaatttactttattaaaatatgattttagtcctttaaataaagttgaattgagaacaaagagaaaaaaataatatccaataatgtcagttcagatattgtgggttaatttaaggatgaaataaaactatataaatttgtccatgtccccatgagtttctcagtgttttgaggttttgctcagattcatttacacatatggaaaactttttaatatctacataagggattcacattcgaagggatttcattttatccctcagtgaaatgaaatcccttcaaatgtgacttccttacaaagtctggccatagtcttgaattatcttagctgcattttctctaaagcgtcactgtccaactgaaatatactgtgaaccacaaatgtgaatatgacatttaaatagtctagtggcaacattgaaaaaataaaacaggaaaataattttaatgtgatataaacatttaatataacatatttaatatatttaatgtaaaagaagtatacttaattttaataaaataatctagttaaccaaatataaatgttaacttttcatcatgtaacgaatatataagaatgacccatgatttattttgtcttctttaaaagaggtttataatctttgcttacagatatttcagtttacactagccacatctgaagtactcaaagccaaatgtggctagaaagactattgaacagagacgctgtatggtacatattcttattagataactattatttaaggaagtagcataagaagatattttaaatgctaatttaaaattctaatgacaaagccatgttttatatgatatgtgtgaataaaacatagtcagatcttttaagtgaatgttttctttgtatatagagagagctgtttctgtctgtggaaaatttctgctgaggaaagaactaacaaatgacaaaaagaacggctttgcctgggacagtagcagaggaaactaagaaaaaggatgtcctaaaatgagttaagaaaatttttacttagaccctggacatcatagattataaaaggagcatttaatgacaaaaatatcataatgtctcaatgtacagtgaatcaatagtaccttgtgggactgttgtctgatactaattgaaacacagtatttgaaagctacagttgtttggtttgagtatgactgtcttcatcagcaagaataccttacatagtgtctgttctatttgctattttttttctattcttaacttttatgggtttatctttggcaaaagctgattttataaggagaaaatctataaattgcattcatggttatgccaaactcctcaggtacaactatcaaataccagcactttccagggaagattgtcttcaggatctgatcattcagcattttaccagaattgttgttggaatctatggagccacagtctctgttggactctatataactttcctccaacctggtcagaaccatagctaatcaagtaataagacattatgacaagaaataccccttacaaagacaaccaaaagagtcagcatccagtattgttaaaaacagttccaagtgtaaccaaatgtttttacttctcaatatttttttaaagtagcattattatatgtaaaatataagctttgtatggcagtagtttttgcattaagccagaacttactatttttcctgaaaatacttactaatgtacagaacttttttattataaaataatgattggattagaatgtatcctaatgactttcaaacatttaattttattattttctaaaatgttattaattttgccacagattattctgccttagtgtactgtcaagataaattatcagcagataggaaaacaaaaaaaaagaagtcaaattttttaaaaaaataaagagaaactattgacatggctcctagaagtctgttgaatccaattattgctttgtagtcactttgttacttcttgtttgcctcagttttatatttcttttgtctaggagggtgtatttttaaaatatatatagataaggataaatataaattaaaattgagaaccttaaaatgcatatgcacactcacttgtacaatgggatgattaaaaatgtgtttaaatgatggaacataggtagctgatacatctaatatttaagacctcacctttacttcattggtaccagtcactaagataaaaggcatattatttattcctaagatcaatttaagtgatttgagattctgactaatagattatgattaatcgtctgtagaaagggattgtgttgagtctgcactaatgggtactctaccttgtctaacatccctgaaaggtaaaacatgagcatcttcatctgaatggaagagagaagtagaatcgttggggaatgagtggagaatgaagatagtgcctctgaaatgcagatagctttctgtggaattaatcagtgaacaagttcataaaaaggaaaaaggcagagatgaatgaggggctctagcagaaactgcaattgggtagaggtgctggcccctaaaagggtttatttaataatctaattgactgttttccagagaggagttatgggtttgccaacttgcatgaggtggcaaggggtagttggatagatggatgctagacaattctagaaacgtatctaggcattaaaaatgattttgaatttgcttacaaatgcttactttcaactaagtactattgtgtactctgctaaagtataatttttacgttgtttttgttgctgctgttttgtgaggggagggaaggatctaatattatagtttctaatgtaattctaaggtacttaccttttcactagcaatgacatttctagtaacctagccttcaaaattgctcattctcagaggtatattcataacagtatttattatagaattatttacaatgagcataaattgaaactaaaaaattaggtaactctttataatagaacactattccacctaaatgaagcacatgtagtatatgttgaaaattaactcaaccatttttcatttcccttttaaaaagatagataagtggttgattcagtaattgatagtgtatttggccatttttgcattgctataaagaaatacctgagactgggaaatttataaataaaatggtttaattggcttatggatctgcagagtgtacaagcatagcacgggcatctgctcagcttctgaggaggcctcagggagcttttactcatggcaggaggtgaaaggggaggagccatgtcacatgggaaaagcaagagcaaggaagaaaggggaaggcgccacatataccaaacaactaaatctcgtgagaactgacttaataccatgagggcagcactgaactaatgagggatctgcctccatgacccaaacacctcttaccaggtgccacctccgacactggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagactctcaccaggtgccactccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctccgacgctggagatgacatttcaacatgagattctcaccaggtgccacctctgacgctggagatgacatttcaacatgagattctcaccaggtgccacctccgacgctggagatgacatttcaacatgagattttcaccaggtgccacttccaacacgagatgacatttcaacatgagatttgagtggggtcaaacatccaaactacatcattctgcccttggcccccacaaaattcttatgcttctcacattgttaaatacaatcatgccttcccaatagtcccccaaagtcttaactcactcaagagttaattcaaaagtccaaagtttaaaatctcatctgagacaaggcaagtcttttccacctataaacttgtagaataaaaattaacttatttacttacaagatacaatgaggttataggaatttggtaaacattcccattcccaaatggagaaatcagccaaaagaaaggggctgcaggccccatgcaagttcaaaacacagcagggtagtcattaagtcttaaagctccaaaatacactcctttgatgaaatgtcccacatacagggcacacagctgcaaggggtgggctcccagggctttgggcagctctgctcctgtgtcttttccgcactgaagtttcaagctgctgttggcaccacccgtctggagtgtggaagatggtggctcccttcccacagctccactaggcaatgtcccagctgggactctgtgtgggagttccaaccccgcatttccccatagcactaccctggtagagtttctctgtgagggctctgcccctaaagcaggcttttgcctggtaacccagcctctctcatactttctttgaaatctagggtgaggttgccaaaccttcactctcgcagggtgcatgcctacaggcttaacactacgtggaaaccaccaaggcttatggtggcttatgctctctggagtggcccaagctgtactgtgaggcctctgagcagtgactggaaccacagcagccattatgataggaggagcctcctgaggtaacactgggcagtagcactctgggcctattcccataccaccaaaaccattcagtccccctgggcctctgatgggaggggctgcctagaagatctctgaatgccttggaggcctttttctcattgtcttggctattagcacttgactcccttttagttatgcaaatttctttagtaaatgattgctgcacaacctacttgaattcttctcctaaaaatgggctttttgtttctaccccacagccaggctgcacattttccaaatttttatgctctgcttctcttttaaatataacttccaaatttaagtcatttctttgttcctgcatttgaagctggctgttagaagcagccagacaacttcttgaatgctatgctgcttagaaatttcttctgccagataccctaaatcatctctctgaagttcaaacttccacagatccttagggcatgaacagaatccagccaagatgtttgctgagggataacacacatgacatttgctccagtttccaacaagttcctcatttccatctgaaacctcagcagcctggacttcactgtccatatcactatcagaattttggtcacaactatttaagcagtctttaagaagttctaaactttccctcatcttcctgtcttcttctgaaccctccacactgttccagcctcagcccattaaccaattccaaagctgtttccacattttcagctatttttataacaatgccctatgccttggtaccaattttctgtattgggctgttcttgctttgctattagaaataccttagaccgagtaatttataaagaaaataggtttacttggctcttggttctacaggttgtacaagcatagtgcttgcgtttgcttggcttctggggaggcctcaggcagcttttactcatggcagaaggtgaagcaggagcttgcacacacatggtgagatgaggggttcaggggtaagagaggtaggggaggtgccacacacttttaaacaaccagatcttgcaacgacagcaccaagccatgaggaaaccattcagatgaccaaagcccctcctaccaggccccgcctccaacgttggtgatgttagaaatgctcgtttcccagtgccgtaaagaaatagcacttgaacataaatttaacttcctcagcaaggccatttttagactttctgcagaaaggatacactcgccagcagttttgccatgagagtatattgaacaaaggagactgggttatttataacctgatccatccactctacttctgtgtccagtttttattggctgaatcggaccttatatttagatggagaggaaagtctctttgaagaggaacctctactttactttttacagtgattacatttctagatgagatttgggcagcaacaaatattcagattatatcaggtagcgacataagaaaagtaaagggaaaagcaaaaaggagtgaagaaatgtacagaagggagaaaaaaagaaacaccgaaaaaagaaatagaaatgataaactttaaccgtaattattttagtgaataaaattttaataaataaaggagggcattttgtagttttttgctttatacatttaaggaatttttttttcctaagcttttcttactagttttaaaatatattaaaaaaaattaaaaattgtatacgtgcatctgcttttcttatttggaggctactgtaatgtttaaactgcattttatttattaatatactccttgtgtgagaaaggaggctcacaaggctatgtaaaattcaacaagctagcataaataaaatgtttggaaaaaataaatgacaaggcaatatgtgatcttaaaacagagtggtaatgaggtttaaaaatatataacattatgtccaaaaatgagattccattatgtctggcatgtaagaagagctcaaaagaagacagatttattttatgtgcttaataataaaagctaattgatgtattctagacacaatacccacagtgtcctcaggactttaaaaatctcatgcatattttacaattaaaataaacattaactaagtgaatggcttatatgtcccttccccagcatgtaatcttgtctagaaccttcgtttggttcactttgtcagtaaaacacagggaaacataaacttctcagaagaggcaacaattaagttggaaatgttgacaaggtaaggtagatatgggacaaatacttattagcagtcatacagaatcttgaatgacacttggggttttcacactctgttgaaaaagtaacgcctatagtagaatgttcacttcttgttttcatcatctaaaaatgtatatgagcaacctggagcgtgtttagaggagtgtgactggaagtggaaagacactttttatgacaagcgctaaaagaaagcagttcgttttggaggccttggaaaaagagcagggacacaggttctgcgtggtattcttttgcaaatacctgaaaccactagttgggaaataaattaaatgaattaataaactaggaactgtagtttgaagttagatggagtggatttggaaccgatttaagattttttaatgagcagatgattgatgaaattaattgtcacacaaattgatgtttgctattaatatttagctttaactgaatgaatacaaggtcagtgctcaaatattggaaatgttcctggactagacaattctaagattgctacaatgctgccagatccaccgttggactttccttaattcttattcaataattaatgaatatgaaattaatcttcataatgtaacattatgaagcacagaaacataaaaacaagtttatctgtgaatgtatcatagagaaaaatgagatttaacatttaaaacagtggataatagtaacattgaggctcctttacatctcgatagatttttaatgtctttgtccgtcaaagtattcaagtatttgtggaattcagctatgtaccagaaataaagtagatcaggtaatacaaacaaacaatttaatatatttcaggagaaaaattagaaaatattcctccttttacaacacgtataaagaaacagctaaattgataatctcaggtttttgctttgtattgaattttctacccgaaaagccttgggcagtactttttcaagaatgatgttcttttcatatttgactttaataaagacagcacattgcccgcgtccataaaatggtagatgagcaaattgctctgtgttttactgctcactcgactcctacattcatagtatttgacaagtaggacttaaatgggaacacttctttttttcttggagagggcagttactctgaaatcttaaatgaatcatattggagtaaggtgacataaatttccctcctcatttattaagatccaatctgcatgcagtactctgccagacacattatattaggttggttaaacagatatgatactagcttcttaagagaataaaaatcagatgatatcaacatagagacccagggttattattcatgacagtgccctgtgattcttcatgaactaatatagctcgcgaaagcgaagggatccaggaattctgtgataaatatgaggcagtttgtcctgaccagagatctaaagattgaaaacagtcatgagaggctttttgagagtctggaggacaagtccatgactgtaaggaggtcatggagaaacaagcaagtactgttacctgagcatcggtttgagtaacaaggagtagacgacgaagtgaaaggaccgagggataaaatgttggtgcccatggggtaagataaccatatcatgcagtcaggaatcccaacagaaactcttgcatattactaggtcaggatgcagatgagggaaaaaataaacatggactgcaagcatgaattctgatactgcagtggtgtagagatagcactacctacagcattctgcctaaagccaatgatctctgagtgggaattgacaaaaaagcaccactctttagagctttaggaatgagaatctaaaagaatttctcacatctccgctagccctcttggactctccattgtgctaatcatattcagtgctggtctctaacacttcaggggtctaaccgaatcacttttcttgtgtttgtgacccagcttgccccgaatgcacaccctttggatatcatccctccattcttggcccaatattgtcccttcactccttgtagatctgaatttaaaagtagaacaagcaggcacttgcatctgcctaaatagtcatgtgaactacattttgaacactagtgttctgaatcttcatttctgcaagatatctttaaagtgggatttggaattttgttagaattacatcagaattattgataataaggcaaataagctgctttccaagggaaacgggaaatctgtatactgtatagtgataaaaatgatgccattaaacatcgtaagttaagctctataaattacccatactccagatagaaaagcaaaccaaacagaattaacccagaaaagggatttcaaattatatagttaacatttgttttccttttttctaccctgggacttattgttatctattagtcaccttccttagaaaacatcaagtctgtggataaatacacttaatagtgttagcaggaatgctattcatgacagacctcaacatgttgactcgtactttatttaagctattatgagcttggcgaaaatctgaaagaaagacgatgcaatttattttaggaaatacttcttaaaagtaaagatttcaaatgtgggagatattcatgaatagaaagagttggttttgctctcattggttctgcttgttttgctactgtctagctatatgagggactttaggaaagccattcctaataaggtgggttttagttttctcatctgtgacattaaggaattagaaatgatcatgtaaagggaccatttccttctgttatactatagattgttattgatacacaaaatgattggttaattcaagttcaattttgttaacctgaaatattttgaattacttttgagagatccttgtttaaaagccataggcaattttgtgtgtgtgtgtgtgtgtgtgtgtgtgtgtgtgtgtgtgtcttttagctcagtggttatcaatggggcaatgttccctttcagcaggcatgaaacaatgagatattattgattgtcacagatatgggagagctactgcattgagtgggtagagactacaaatgctgctgaacgtcttctatgcacaggaaagccgtcccttaacaaataattatttggtccaaaatgtcagtagtgccaagattgagaaatcgtgcaactagttatggtccagattgatggcatacctcatccttcatgatatagtgatccaagtgccttgtcatctaaaccaaacagagcagaatctccaactctccctgccctgagaaaagggactctattttctgtcagacagtaaggattggagaccgtatttgctctcgtgcttgagagcccacatcattattgggttaacagtcatagctagagaattcagtctgtgtattttttttattagtgttattttccctttctcgtaatgtaacaatttttataaatgtttcatgggctatgaaagaagggcatttttcattttcatgccactgctttagcaatgtatagatacaatcaatattatggattgtgatttaggtgggtgttctatatatttacagtcaattaaaaaccattgaagagcttttcattgatttcattaatttctattatcttaataattctatattcaggcagggctactttagctatttgtgtgtatgtgtgtttccgtgtgtgtaaatgtataaatacatgtacatgtgtgtgtgtgcatatacatataaaatcaaaggcatacctagacctaaacaaaatattctgttctcatgatgtaattaatctcataagcaagataccattctctgtgtgacacagtttttttttctagttagaattcacattcactaaatgtttaacactctcttgatttcactttaaaaatagaacatcaggctcacatatggctgctctctacactagaactaccctcaggggtgcacaaattgaatacactcagtatttttctcctggagttttttaaaaactccatttatttccttaaacttttgagacaacagggctgatgttttctgtaatgaagttagctaaatgagctttttattgaaatttattcaataagattcattcttcatgtgtcaatcagatatcacgattaccatgctcaaatccaaattcaaatttttgttttatgagatttcctacacttctggagacttgaattctggtcttctctaacagtcattatctatttatctttaaataaataacttctgtacactgtggattgctttatttatactttggtaatagttttctgctcaatttgacccagagataggctcaggtagtaatattaagggcttctgaaaaatatcaattactatacatatatgagtaatggtggtagtataatttacacattagacagcaaagcaaatcaacaaaaactaaattaaatagggcaaaaagatgctgtggtacgaaattttctggataattttagttttagatcatgttgttaatttataattgagaatttgataaattagttcaatcttcattaccaaccatttgaaacactggctgatatcatggccaggtaaattgtgtcctttttttattaaacgtagttgactgaacacttgcttttcacacattgaattgggtcctggcaatacttggatgaatcaaattgtttccatatccttgagaaactgccagtgcaggcaaaatagggtaacagatgtaataataaatgcatgcacagcatagattggagcaaatggaagcactgacaaactcttcttttttaaaaaaaataattttcatttttttgctgatccataatgtggtacatattttggaggtacgtgtgatagtttgatgcatgtatataagatttaatgctccaattagagtaattgggatatttatcacctcaagcttgtatcttttcttggtgttgggaacgtttcagttcttctcttcttgcttctttgaaatatatttttaaaatgttaattatcatccacctactatactgtcaatcactagaacttattccttctgtccgcatttttgtaaccattaaccaacttctcttcatccctccctccccaatacccttcccagcctctgataaccaccattctaccctctatctccatgaaatccacttttttagcttccacatgagtgataaaatgcaatatttgtccttatgagattagttaatttcacttaacataatggcttctagttccatccatgtttctgcaaatgacaagattttattctttttatggctgactaatatttctatacacatgcacacatatatatatatatatatatatgtatcacatttctgtattcattcatctgttattccatatattggctattgtgtatagtgctgtaataaacctaagagtgcagatatctcttcaacatgctgatttcctttcttaggctgtgtacccagcagcgagattgaataatatggtagttttatttttagttttctggggaaggaacactatattgcttgtttttcatagtggctgtactaatttacattcccaccaacagtgtgcaacagtgtgcgagagttaccctttctccacatcctcgttaccattcataatttttgtctatttgataacagctcttttaactgtgatgagatggtgtctcattgtggtttgattctaatttccctgatgattagtgatgttcaacattttttcatatgcctgttgaccatctttatgtcttcttttgagaaatgtctgttcgggtcctttgccaatttttaattggattattattgattttttttgctattgagttgtttgagttccttatatattctgattattaatgccttattgtttggataatttgcaaatattatcaaattctgttggctggctctttactttgttgatttgtttcctttgctctgcagaagctttttggcttgatttaatcccatttgtctatgttgctttgcttttgttgcctatcttacacaaaaaatctttgcccagattaatgtcctgaagaatttccccagtgttttcttctagtagtttcatatgttcatgtcttacatttaagtctacaatccacgttaagttgattttgtatatggtgagagataggggtcaagtttcattcttctgcatatgtatatctcattttcccagcaccatttattaaggagcctgtcctttttccaatgcatgttcttggcacctgtctagtggacaaacttttaatttttctgtgagtaaaagcatttggacagatgttattgggagtggtaatatcattctttgttttacaaaacaactctgttaatagtggaaatgttaggtcaaaagggtgaaaaatgtttttcagagatatcaataaaagtctattgcaatgcaaaataatgtattgggtatggaatagttacaaaaatctttgtgatcttgattaagaagtgatcattctacaaatagtgacatgttgaacatataccatgttcttacctctgtgtttgtcatctcatataaactaagtgcaatagataaaatttggtttaatttgtctctacaaatttaattgtaagagtttaggatttgggatatcattaactcttttaaatctagagacaagcacattgcaaaaagattttttttttaattatcaggtattaaagacaactgagaagtgttatactgaaatacttaaatgacataatttaaagattaaaatattgaggtaagtgttagggtataggtctcacttagaaagtacctgatttttgttcattggattcttaagcacactcattagaactcaaatattagacataatcaatcaaccacttttaaacattatttattgaggcccatttagaatcttggcaaggtatgatgctggatgttacagagaatagggtgggtattgaaaaacaacaataatgaaaaataggacaggaacaaacacttgggagtttaaaaaatatggaaagctattggtctaatttgaaattttctttttctggttctttaagatcattcagtttatgtgtacaactgtattttgaggtagaaattgggatatatatatgaggcattttaaactgaaccatctttaattaataatttattctaccccaataataattaatattctagcctaccaatagtaaattcaaaattgtggtctaacagtatgtaagatactgcaatttcacaaagtataagatacaatatttctcaaaaagaagcatatagtctcatatcggtaagtaatcacctgactatgtgacgttaaatcagtgtcatttattgataattacacaccaaaggaatgcagcattttagagtcgtaagagacttccaaaatcctctaatctggcctcttacatgatttcatggaaaagatgtttgaattaattcaaaataatggataatagggtgaagacattccctaataccagcaaggagatttctactgaattaactctcttctagtggatagctcaaggggcaaccttttttatacatacaaatcaccctttgattgtaacctcttacgtaagttttcagcattagagaagaaatatatttgcctatttctaactttatagagaggattgaaattgacccagtgctccatctcatctcatgccattcaaatcactacacagattccgaaaaggagtctatgaggatgaagtggagtgaaaatgattaaaagaggaacttgctagaagtggtttaagttaagtgtgttactcaatgatcttcaggttgataagctcaactttagtattatctaagttatttatgacagtttcacagataaacgtatatgtggtgctttgaaaattgaaaaacgatgctggataggaaaacaggtggcaactgaaatattcataatccaatgtccctttaccttaatcatggactaaacaacagtttacagtacagtgtgtgattatattaagaatatgactaaacatttatgttcatctagtagaaaataggtgtgaattttgaaagtgataaatgactaccttggtggtattgtaagagctgtcaccaaaaatgagcaaaaatgatacaacgttttgttgtgtctaaatttttattcaaacaatataatttcttttgtaacatatgtctcattttattaaattcattttatgtgccacatattgccaaacagctcacattcaagtacttcaggagaaaaagttgtatctgctttgtatattgaaaataatcataagtttcttcatatgactagggattcaagctgaaaaaaatgagagatgggcctgttaacgtggatgaaatctcaaattaaacaaaaaccatgattaaaaaatggtgagagtaagcacgtgaaaagatgttaaacatcactaaccattaggaaaatgcaaatcaaaaccacaatgagacaccacttcacattcattagaatggctgtcatgaaaaaaatattgcaacaacaacaaaaataacaagtgttaacaaggatgtggagaaattaattggaatctttgtgcattgctgctgcggaagaaatggtgcttcctcaaaaaagtttgcatagaataactacatgataaagaaatgccactgctatgtatgctaggtatatactcaaaagaatggaaaacaaagacttgtacatatacttgcgtgccaattattataccaacattactctcagtagccccccactccccgaaaagtagaaacaactcagatgtttattgatggatgaatagaaaaacaaaatgtggtatatacatgcaataaaatattatttagccttaaagaggaaggaaattctgacacatgctatcccatagatgaatcctaaaatcattatgctaagtgaaataaagcagacacaaatggacaaacagtatgattccactaacactatgtacctaacacagtcaattcatggaagcacaatgtagaatagtggctaagatggtcatggaagcacaatgtggaatagtggctaagatggtcatggaagcacaatgtggaatagtggctaagatggtcatggaagcacagtgtggaatagtggctaagatggtcatggaagcacagtgtggaatagtggctatgatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagtggctaagatggtcatggaagcacagtgtggaatagcggctaagatggtcatggaagcacagtgtggaatagtggctaagatggtcatggaagcacagtgtggaatagtggctaagatggtcatgggagcacagtgtggaatagtggctaagatggtcatgggagcacagtgtggaatagtggctaagatggtcatgggagcacagtgtggaatagtggctaagatggtcatgggagcacagtgtggaatagtggctaagatggtctggggagacggaataatgtgaagttattatttaatgagtacgaaatttcagtctggaatgatgaaacgtgtcaggacataacagtgatgatgtttgcactgcagtgtgaaaacccttaacaccactgaactgtacacttaaaaatggttaaaatgatcattttatgttacatatattttatcacaacaaaaatagaatattttaatcttgacaaacgtaaccacagaaaacaacttacaaaatagaatttcagaaatttttgctaaattggaatacatgctgttttatttctacgagaagatggatagtaggttatttggagctgaagaattataatgcagcttccccaaattgtgatctcctatgtggcagtggttagaaacaaataaaattcttatctcttatccttaaagaaaatcgaaattaccacacatgtatttattcagatagctgttctgagttagacggcaaaatagagcttttattaaaaagtaggatatattaaatttaaacatatataatgtgtagatcaaacattcaaaaagcagaactaattaaaaactggataaacattttagaccatattaaaaattttaggccgcctttctaaagtctagattacattggattaccattgtagaattgaagagtggttggttttgaattttacagttgtaattgcaaacttgcaaaaatatatattttaggtgctactatttcttaattttcattttgtaaattaactagctcttttgaacagcatttttttttcttagtatgatgcctatgagaaaaactacctgccttggaggaatttgtaatagagaaagataatatgtgtgtgtgcgtgtgtgtgtgtgtgagtgcatatgtaaatatttccatatattatatgaaaagtgaagttgaataacaagagaagtttttctttgctaaggaaaaaatacatttgtttttcattaagtaaagattattatactggcattattttgttcttacattggttttcagaaagttcaatggcatattccgctgtatgagccatgcagagctgcatttatctactgtattatcttcctcccttttttctagatattccttttttgtctgtgtttttcttcctgctggtttagtgttatgcatatcttattattttactatgcaatttcttatcttgttgtacccaagcgagttagtgagaacgccacactatgagatgaatcaagagtcctttattaagccggcggccaaagagacggctaacgctcaaaattctctcggccccgaggaaggggcttgattaacttttatacctaggtttaggaaggggagggggactcaaatgcaataattctacagaagtaaaaacatgcaagaatcaaaagaagcaaaatggttacagagagataaacaatttaaaagacaaatggttacaaaaagagcaacggtaccaggtgcaaggctctaaatctttcattataattagatacagggagtatgccggacaggaactcaaggctttatgttttctctctttaagaaaaatcctgggaacttcatacattgttggtgctagtaccttatcagttcattgggctcctttgaaatgctgaggatctgcttacacaggtcaactcctggcagaagcgggttgggtaaggagcccttagtgtcttgtaaattatggggtcaattggagtttttccggctttcccagctagagagagtcttatttacatgagaagcaaggctaggtgattaaagagacaagcaggataaaattcaaagtagcgagttagagtaaaaacaaggttaggcatttcaatcttaacgtcagaagattttgaggttaaataataaaaccaaatctaataaaagtaaattataaaattggtcacaggaaaaaaagggggaaatagataaatataatgtaaagagccaaaggtgagttgaatatagtgctgtactgaatcccgagttgggattaacctagacttgcagctggagttcttcagcaagctgtgatgtctctgacctagatttagctatttgatatgagatcttgtaataggtgaattttgttatgtgaagttgtgggggatgaagttggaaaggactttttatgtgacctagaatcatctgtttgtcatttgaagtcagatgaactattctctcttctgggaatctttcctacttctgcctattcatatttagggtaaatgattattgtgtttatctgagatgccctatggttatgtttgaatattacttacctgtctcaacaatgtttaatacggtagccactagtctatgttagactattgagcacttgaaatgtaattatttggggctctgagtttctcaaatcacatggttggaataaatttagactgcatacatgtggagggacagacctagttatttgattcatctttcccatgatgaatttaaacttttaaatttttttgtcagacctatgtcaagacaagtttcttttttctttctttctttttttttttttttttttgacagagtctcgctgtttccccaggctggagtgcagtggcacgatctcagctcacttcaacctccacttcctgggttcaagtgattctcctgcctcagcctcctgagtagctgggcctacgggcgcaccaccatgcccagctaatttttgtatttttagtagagacgggatttcaccatgttaaccaggatggtgtcgatctcttgacttcatgatctgcccgcctcggcctcccaaagttctgggattacagacatgagccactgcatccagctgacaagttttttttttaaatttgttgcattggttaagtttttttgtcttcactgtgcttgtactctgttaaggtcctagatttaatgcacaagcctcagttttaaccaattagttttggtaggcccaaagctcactggctctgtaagaggatcagaatctaattccttgatcagatatccaggtccagtgctcctctgctcctaccccttgtcaccacggctcttgcaatatattatctgtgtgtgtgtgtttgtgtgtgtgtgtgtgtgtgtgtgcgtgtgtcgtttcattagaaatctctaggtgttattttaggattgtttctgagttagcgtaattcctgatttgggggatcaagaagattttattaacagtattcagtgtccagtggaatgttgcttaggatttgtaagagaggaagaagatcaaaatagtgctttctgaagatttttctggttgtttgcctgtgagcatattacaaaggaaagacagtcgaacaagatgccatttatttaatggctttgatgatgaatgagaggaaacttgttttaaactgaacacaaatctaaagacaaatttactaaatataatttgtccttttcagatctatgtacagttactctcccttacaacgatattaaaaactctcacagacattttttttctcccaagaggattacattattgagaaatgtaaggggccttaacacttgccggaataattaatattttgtccgtcatctatctaagatgagttgtctcgaacagttctgtatctcatgtggctttagtttgatcttagaatactggcttagaaacctagggatagcatggtctggataaaaaggaaggtctgtaacaatgattgaggctattggtctatattgcaaaacattttgcacatttgtactttttaaagtttctcttttttattttacattgatgctaataaaaaggcttttaaaaaatttaccattatgttctaataaaagtccttgctttgatttggaaaggctaagttatgagacagccacataattttcattaatatcaatcatgtgtacaaatattttagcatgaattcttaaaagcttaccacgatttgagcacagttttgttgactgatgctttcaactttcaaggcagaagatattcaaaagtagcaaataccctctccagacttttttctctgaatgtgaaaagcctataattagcaagtattttgtcacttggtaagggaaatgcttcagagataaacaactcatggactgtgaaacactgtagcagaattccaaacatttagatttggaagttttttattcattcgatatttgagtgcctgttaacgtgaatatgcagtgctgaattggacagattttactctaatggaattaagaatctggaagagaagacagacattacatttatgattatagataggatatactgtaggtaaggagaagtgttgaattttctgaatgtttatatcaaagtaatttaggtcaagattatgattcacaaaatgtggttctcagacaagtagcattaacatcatcaggaagcttcttagaagtgcaaattctaggctccacccaagacatactgagtcagaaatactggggatggaactcagcaatctgtgatttaatgttttctaggtggtgctcattgctcaagattgagaatagctgttctaggtcagagtttctcaacttgagcactattgatatttgggccagaaaattctttgttacaggagtctgtttcgtgcattgcagtttgtttagcagcattcctggcctctaaccattagatgccagtagcatcccccagtagtgacagccaaagatgacaccagaaattgccaaatatctccagaaggcaaattcttattagcagttccctgcttcccctcccccacattgccccaggcaatactcaaatgacttgccctgccttttatcttatcctatagtgtgtggtaaggtgctctgaaacaggacaaaggaattccaccatgtttattcattatgaaagaagtaaatttgagcccaagaccagagatggtccaagttctggtcattttagtctttcattttttgccttgttttcaacctatttttcttctcacttcaataaatactcttatatattaatcctgttttatccttaaatagtaacacattctgtttatgttctaaacttagtgatttgatgaatctcatgtaattaacatgacggttagactcaggcacctgcactttccaaagatctttgaacataattaagaaagtgaagggcataattttaatagtaaatcaaaatattctcattgatgaattatgttataataagtctctgtcaatcacagattctcttgggaatttgtttctttccaagaagtgctgagtctttctctgtagttactcatctattatatttcaaaagtgtttctgaatccatggttatgaagtaggaatatccagtttcttatctgtctgttaaccaagttccaaagtgttttagttttctgggttttagactataggtggtcctgtttgagattgctaagacccaagtagataagagtagttgcatttaaaaagcagagattactgcaagtatagaagtaatgcattttggtaggtttgcaaacatatgtacactttctaaaatgtctagatagctgtgtacctatggaattttttcacaggttagttttgctggtaggcctataacaagattcaattatcattaatatttggctcacattagctaactcataagggtcagtgatatggtttggctctatgtccccacccaaatttcatctcaaagtgtaatccccgtgtgtcaagggaggcacctagtgggaggtgattggatcatgagggaaattcccccatgctgttcttatgatagtgagttcttatgagatctgatggttttataagtgtggttaccctgctctctctctctttcctgtcaccttttgaagaaggtacttgcttctcctttgccttctgccataattgtaagtttcctgaggcctcctcagccatgcagaactgtgagtcaattaaatctctttcctttatgaattacacagtcttgggtatgtctttataggagtgtgaaaacagactaatataagaaatttgtaccagaagtggggtactgctataaagataacatgaaaatgtggaagcaactttggaactgggtgacaggcagaggttggaacagttgggagggctcagaagaagacaggaagatatggaaaaatttggaactttctagagacttgttgaacagttttgaccaaaatggtgatagtgatgtggacaatgaagtccaggctgaggtgatcttagatgaacagtttcctcagagatgaggaacctattgagaactggggcagaggtcactcttgctatgctttagcaaagatactggtggagttttgtccctgccctagagatctgtagaactttgaacttgaaagagatgattttgggtatctggtggaagaaatttctaagcggcaaagcattcaagaggtgacagagcataaaagtttagaaaatttgcagcctgaccatgtggtagaaaagaaaaacccattttatggggagaaattcaagctagctgcagaaatttgcataagtaatgaggagctgaatgttaatagcgaagacaatgaggaaaatgtcttcagagcctgtcagacctccatggaagctcctttcatcacaggcctggaggtctaggagggaaaaatggttttgtaagatgggcccaggaccccactgctctgtgcaccactgggacttggtgtcctgcggcccagctgcgggtctaggaggtctaggagggaaaaatggttttgtaagatgggcccaggatctcactgctctgtgcaccactgggacttggtgtcctgtagcccagctgctccagctccagccatggatgataagggccaaggtacaactcaggctgttgcttcagagggtgcaagcgccaagccttggtggcttccatgtgaagttgaggctgccagtgtgcagaagacaagaattgaggtttggcaacatttgcctagattttagagcatgtatgaaaatacctggatgtctaggtagaagtttgctgcaggggcagaaccctcatggaaaacctctgctagggaaatgtggaagggaaatgtggatttggagcccacacacagagtccccactggggcacttcccagtagagctgtgagaagagggccactgtcctccagaccccagaatggcagatccatgtgtaagaattaaagaaagaagaaagaaacatgaaaagcagctcaacagtcaaagacacttttattttttaatataaacctgagagggacttctgaccgatttcagtcaggagcactctctcttacagactaagagtatttaaggattcagggtgggaaagcttatcacaggctcggaatgtttctgtgtctctttgtcttgcttctctgggagagagactttttgtgtctatttccatatatcttcctgaagctgcaggcatacccgtctgagttgcttttacctttcctatcttagtgcacctaaagggaaagggatgtgcttattaggtccactattttactggggcccattgtattagtgtgaagtttggcgattaccaacacaccttcccccttccttctgtgcctgagctgccttatctgtgttttactgtctgctcattctggctgcttgttgttaaaagagaagtgatttccttgaaatgcacgaggttagaaagggagctggaacttaaaacagtggtatttgaccaggatgacagtgctcttgctctatcaccatgaacagcttgtaatgtgcacctggaaaagctacaggcactcaacaccaacccatgagaacagacgcgggggtggaacactgcaaagccacagtggtggatctgcccaaggccatgtgaatacaccatttgcattagtgtgtcctggatgtgagacatggaatcaaaggagctttaagatttaatgactgcccccactggattttggactaggatgggggcctgtagcccctttactttggccaatttctcccatttgaaatggggacatttaccaaatgcctgtacccccattgtatcttggaagtaactaactggtttttgattttacatgctcataggcggaagggacttgctctgtctcagatgagactttggatttcagacttttgggttactgctggaatgagttaagactttcagggactgttgggaaggcatgattaaaatatgaaaagggcatgagatttgggaggggctaggggtggaatgatatggtttgtccctgtgttcctacccaaatctcatctcaaatataatccccatgtgtcaagggagggacctggtggtaggtgattggatcatgggtacggttcctcccatgctgctcttgtgatagtgagagagttctcataggatctgatggttttataagttgtggtgtcccctgctctcttggtctttcctgctgccttttgaaccaaagggacttgcttctcctcatcttctgccatgattgtaagtttcttgagatctcctcagccatgcagaactctgcgtcaattaaacctctttcctttgtaaattacccagtctcaggcatttctttatggcagtgtgaaaatgggctattatagtcagtgagggtcaagcatgttttatctcaaccaacaacagattcttgggtaggatggcagtaatgcagtttgataccaaaaggtgatggataggatgatgatgataataaataatatgtaataagaacaaattttagaaggatatgtttcaaagagtacagaagtttgttagacctgactggtattggatagacataacattgtttaagttcgacagaaggagaagatccaccctgtgtggggaacaatgagaacaggtctgaggtacagtgaatgagattgttgatttatgggaacggtgaagttttggaaaatacacagaatgagatgtggcatacttgaaagattctattccagggaaaacatacacacactggaaaatggagatctcccttagagactcgggatagagaaagaagcagctaaaaagaattgggttctatcagaataaaataccaccagtcaataagaagataatcaattaaaaacaggctaatgacaaacactaccataagatgataacaaaagtctacctgcattaaataaactgcacaattgtactttaatgtagcgggaggtagaacatgtacccttgaactaaagctaaagccaagtgagccccctcctcccttgagtatcatctgctagtatgggagaaaaataattcaagacataatcctgatcataaggaaaatagaatccaatgtttgtaaaacttgctatataaagaaaagtattgcttactattgctggacaagaaaaattcaagatatgaaattctgatcattaaaaaggatcccaaaatttattaaaatattatgtgtaatgaaaagataataaatatttattgaatgaattcctcaattttcctatgaattgagaagtgctcatgaaaatgcataggtaaattataaaatgctattccatttcattcagggctctgctgagctgaaataccacagagatccctttccagactgaattgtttgaaaaagttctccctatcactttcttcatagcacatatcatttgaggttttactatttttctgtccttcactagagaataagcaccatgtggtcagtgagttcatttgttttaacttgtggtctctcatacctagaatagttctggccaaatagaagacactcaataaatatttgttgaatgaataaatgaataaaaaaacttcattaaatattttgaagggattttcatataaaagaaaaagaaatgctgaacttttcagcaaagtaacccatgtatttgagataaaattaactcctccactttaagtttgatttacgcaaaaaaattgtacatttttaaactataattgtaacctgataaatatattttctaaataagttaataaattttggaaaacatttgatgcaagatatactgtgagagagccatgagatctggccagttgaccatgttactattggaaatgttaataaaacagtaagattgctgatgttgctttccattagaaaaaaatatcagagaaacatatgctaaggggataaacaaaaatgaggagtctagagtctacttgatcttagttattgagacaattctattaacaagagagtggggggccaatataatgtggtctattaacaagagagttaaggatcaatataatgtggtccttaactatatccttacataatttgacacatgaatgtgcaacatagtaaagcattagtgactttatcatgatgagcatcagatttaggatcctgtaatgaacacatcccagtctctcttctagctaaatattgaagtcagaatggagagattgcatcctttggaggcttgacggagactttgattgccatttggccttaagctccatatcaagctaacatgaattagaaaattattcccacactgctgtaaaggtgaagccatagactccatgtcagatcctcggcacatatgtaattgagtttgtgccataaatagcaaggtagtacagaagttacgtgaaaattagtctgtactatagttacaaatatgtatagtaaaaattgtgattaaattcagggcattttaaacttgagttgtccttttattattcggagacaaatatagtaaaatctagaggagtggttttaccccaaaagcccaagaattattcatcagcagaacaaaggcataaattgaggcctcttgaatcccaatccttttgtactctttaatacaggtactcttggatttatggtgagtttatgtcccaattagcccatcataagttgagaatatcataagtcaaaaatgcgttaaatactcccaacctaccaaacattatagcttagtctagcctgtcttcagtgtgctcagagtacttacattagactgtagttgggcaaaatcacctaacacaaagcctattttataataaggtgttgaatatctcatgactgcatgtcactgcctggaaaaagataaaaattcaaaattcacagtacattgaaattgtgatggttttatatcatcgcacagtggaaaaattactaacttgaaccagcataagttgaagaccatctgtatatgacacttacctgcagagaatcatctggattctaactgaataaagccctcaactgagatttttttattgcgaaactttgatttgaaacacagtgaataaacatcaaaatataaggtacaaagatacaagtcaatactttgaatataagaaaagcaacctttgacaataagattccaagaccaggatagtcaacattactctttcatcgtgactttaggatgaccaaggcaggcacaatgaagataaaatatggcatatccttgttcttcttcagagccatgagtatttgctttttgtttaaaggtgtttttagcagcttgaagaagctgctaaaccattttttgactctgaatgttcaggaaactatgttgagctctgaagatgcaataatttttaagttatctacatatatctctctctttcttaccaaccatacatctgtgcaccatgttagattttatttgttatgattctcaaaataggagataatgaaaatattaacagactgctgtttagtttataaaatgctgtttttcagttaatattaaattctgaacaatatgactagtattcttatggttgtcttactcatgaggaatctgaggctcatagattgtaatttgacacaaattacaaaccttctaaatggaaaagcacaagatagggatttctgactccaaagccagtgtttgtttgtttgttttcttactgtgttgcttgtagcatctacttacaggcattattattattgcttaaaaaatcttgccatctgtttacattgacttaccactttagaaaccatttgctaaaaagttgacagtataataaaagtattccattattaaggatgaataattagaactagatgtgaaaggtgaaagggtagagtttaaatacatataatttattatttaagaaacttctaataaagaagattcttttacaatatgactgactataccttccaaaatttcagtgaatgttattaaatcagcatcctcaaagatttcatgtctgccaagtgttgcagacaaaaataaaactctttgaaagcatcttgccaattgtctctagctcctttatgtgatgaaatgtttgtagatttattataaaatcataatttccattttagtattttcataatactatatttgatagaagtcacttaattaaaagtgttgtcaagggaagtcagctgaaaattaagaaagcacagacagctgcctctgttgctaccatgaaatttatgtcttttaagaagtactttattctcattcaacaatgtttgcatgttggttaatttcaaatgtatctttcaaatttatgaatgtataatttttattaaacaaaaacattataaaaattaacgcataaaagtgaaatactcatgtttttatacagttaaatttagaataaatgtaagttttttgaaggaacaaagtatcgtttgtataggagagaaagaatgtgtgtatgtgtttgtgtgtgtgtgtgtgtctgtgtctgtgtatctgtgtttatagaggtggtgaaaatttattaaatccccccaaaatggaactggatatgacattatagtgtatttggtctacctagaccaccttacttgtcaacagatgggagccaggagactttaaataagtatcttaaggtcacatagtatgttagtagcagagcagaactagaacagattttctcattctcagttatcttttctcattactcttcttcttctttagttttatttgttatttgtgataatttacagtgcatttgtgaattgacatgcctatgagacttctgttggcctactttgcttaatcctaagagggctattacatgaggacatctgaattgagaaaggcaggaaaatgtatttaggtgtgacattaatttgtgacctatgaaagtgctgtagcatgcccccatatctaggccttcagtttaaacaaattggttaaataggggctgtggctcccacactctctaattcctaaggcttttctctcccatcccaatgtaagtcaatgctgattgaacctcgttcacttaggagtgtccttgtgactgccttctgggtataaatgctcaagataatgatgacacgtatggtaactgtattctcctgtattctgagagatgaaagtgaactgtgattctgcttgcaaggtatctgtgcctgcttgtattcttccccagcatttcccagtctttctgacttttccatagatcttcatcatttccatagacatttgtcttccttctttttttaacttttacatgtcatatgggagtggcccctgtaagtatcatttgttcttacccaactttctctatgacataagaaaccttttaaatactgatcaaaataattcaggcaatgttctttaataatataaaatataagtattgtgtttcagatgaatcagacatattcgtttagtaggtcagattctccatatcattatagtgatgagcatatagtaggatttatggaaatacttcacttacatttcccttatggagatgacaatagtaagaatttttactttttttcttacctttcactacgtaaggatgagcttggattatttattttaaaatccataattaggcatttccaactacttaatatggtttatataaacttactaggaatatctgttgaattaaaaccttaccttatgtttgattttaaatgtacctgtcttaatccttaaaataagaagggtacatttttttcaattactcctcacttaagaaaagatattcttgagtagttatttataataaggagatcatggactacttacattttaactcaaattcttcttaagtgtttacatttttaaatattgattattgctagaaggaactcatacattaaattggcatactctttttttattcttttcttgccttattttcaattattctataaattagaaaattttttttcttagaataaacaaaatcacagtgttctgagattttgcaaagtctatgtcactgaataacagtgaatatgatttttccttatgaatgagaatattttctctggcaaaaatagaattaaattagaaatcaactacacaaataaatttgggaaaccctgaagtatttggaaatttatgaatatatttctaaaagaggtcacaagaaattgtaaaatattttggactgaatgaagactaaaatccaacatttcaacatttatagaatgcaactaaaacggtagttttgggggaatttatagttttaaatgtctattttagggaagaataatattctcaaattaatatccctagcttaatcttaagaaacttaacaacagaaaagcaaagttattcaaagcaaacagaaggaagaaaataataaagattaagatggaaatatacccaaaagttaattctttaaaaagaccaacaaaactgacaaaatcttacctagatttactacaaacatgagggaaaacacaaattaccaagactgacaatgaaagagatgacatcattaggaccctaaagacattttaatatattataaaaatgttattataataatttagataactagcaaaaatggataaagtcatggaaggacccaaattaccaaagtggggtcaatgagaatttgagagtatgaataaaactataaaattgaattagcaatttaatatcttctctaaaataaaagccctctatctcatggccttattcaaaattctgtgaaatatttaaagaagaaatagtagtaatctttcctactggtaccagtaggaaccataaaaatgtattttattaataggctagtgtaatcctaattctcatatcagacaaatgcatcacaaggaaacacaaccaaacagataaataaacaacaaaaactacagactaatatttttcataaatgtagaggcggaagtctttaacaaaatattaacaaactaaattcaagaacatataaaaagcattatacactgtgaccatgtaggatatattccagacagtcaaggttggtttgtcatctaaaagtcaaataaggtaatacattatattaacagaataaagtaaaaagcaacacagtgaactcaatatacagaaaaaaattgaaaaattctaatagtcatgataaaaactctcaaaaaactagtaataaaagggaatatctttaaaatgacaaacagtatttagttcacagcggatataatacttaatggtagagaatgttaatttaatatttctattaaaatctgaaatgaggcaagaatgtctgttctcatcacttctattcaacatagtactgaaagatctagccagtgcattaaaaaggaaaaaaaagcaattaacagcactcaaattgaaagagaaatgtacaattattttacttctcagatgacatgatcctttatgcagaaaatacaaagagatccataataaactacttgaactaataaacaaatttaccaatgtcataggatacaagattaatataattgtatttctgtgtactttcaaggagcaatctaaaaatgaaattatagaaaaattatatccatgacatcagaaataagatacacaaaaaaattaagaatataatgtaaatgtaagtataatatatattaatatagcataattataatgaatatgaaataaatataaatatgtaaaataacatcacaaactaagaatataaataaaaaagattaaaaaatctgtgttaaaaactacaaaatgttgctaaaacaaattgaagatctatataaatggagagacattccatgttcatgaattgtaagtctccatactgtgaagatggcaattctcccaaaattgatctatacattgaatgcaatttctatcaaaattctaagtaggctttttttggaggtagaaattgatgagctggtttagaaatttatgtgaaaatgttaaggacctaaaacagccatgacaatatttaaaaataagaaaatggccatactgcccaaattgatttatagattcaatcctaccccaatcaaactactgttgactttcttcacagaattggaaaaaactattttaaatttcatatggaaccaaaaaagagctcacatagccaagacaatcctaagcaaaaagaacaaagctggaggcatcatgctacctgactttaaactacaccgcaaggctacagtaaccaaaacagcatggtactggtaccaaaacagatatatagaccaatggaacaaaacagaggcctcagagacaacaccacacatctacaaccatctgatctttgacaaacctgacaaaaacaagcaatggggaaagaattccctatttaataaatggtgttgggaaaactgtctagccatatgtagaaagctgaaagtggatcacttcctttcaccttatacaaaaattaactcaagatggattaaagacttaaacataagactaaaaaccataaaaaccctagaagaaaacctaggcaataccattcaggacataggcatgggcaaagacttcatgactaaaacactaaaagcaatggcaacaaaagccacaattgacaaatgggatctaactaaactaaagagtttctgcacagcaaaagaaactaccatcagagtgaacaggcagcctacagaatgggagaaaatttttgcaatctatccatctgacaaagggctaatatccaaaatctacaaagaacttaaatttacaagaaaaaaacaaccccatcaaaaagtgggtgaagaaaatgaacagactcttctcaaaagaagatcattatgtacccatcaaacatatgaaaaaaagctcatcatcacttttcattagagaaatgcaaatcaaaaccacaattatatatcatctcacgccagttagaatggcaatcaataaaaagtcaggaaacaacagatgctggagaggatgtggagaaataggaatgcttttacgctgttggtgggactgtaaattagttaaaccattgtggaagacagtgtggtgattcctcaaggatctagaactagaaataccatttgacccagcaatcccattattgggtatatacccaaataattataaatcattttactataaagatacatgcacacatatgtttattgtggcactattcacaatagcaaagtcttggaaccagcccaaatgcccatcaatgatagactggataaagaaaatctggcccatatacaccatggaatactatgcagccataaaaaacgatgagttcctgtcctttggagggacatggatgaagctggaaaccatcattctcagcaaactaacacaagaacagaaaaccaaacaccacatgctctcactcataagtgggagctaaacaatgagaacacatggtgaacagtaaggggaacatcatacaccgggacctgtcagtgggtgaggagctaggggagggatagcattaggagtataggagtaatacctaatgtaaatgatgggttgatgggtgcagcaaaccaccatggcacatctatacctgtgtaacaaacctgcacattctgcacacgtaccccagaacttaaagtataataataaaaacaaaaaagaaattggaggaattgccatacccgatttcaaaacttactataatgttacagtagccaagaaaatgtggtactatcataatgacaaaaatataaatcagtgaaatagaattgaaagtcaagaaataagcccttaggtttatggccaattaatttaaaaaaatagcaaggcaattcaatgaaggaaagaatagtattttcaacaaatggtgataggaaaattatatatccacttgaaaaaaaatgaatttagaccctgataccacaatagaaaaaaaattcagaatatagaagaccttaatgttagcactaacactataaaactttttagaaaaagactaccagataatcttttaccttgatttagacaaatattcttaaatgtgatatcaagagcatcattcataaaagtgaaaattaataaacttgacttattgctaagagaatgaaaagtcagggagaatgaatttgcaaaccttatattttatgaagatcttatatctaaaatgtattttaaaaaatcaaaacaaatcaggcgagagattttaacaaattttttaccaaagaattcatgtgattgggtaatacatacatggaaaggtgctcaccatcattatctttcaggaagtgcaaattaaaaacataatgaaatacctctatatatctacaagaatacctataatcaaaacggcaacattggcaaaatgcggagagactagaacctttatgcattgctggtggaaatacaacacttggggagacaacgtgacagtttcctaaaaagtaaaatgtgtacttattacataacccagtaattccactgttatttatatgccaatgcaaaacgagacatacagctatgcaaaatcttgtacaggaatgtttatgacaacattctttatatacttaaacactgcaaacaatacagaattctattaactagtaagtggataaaaatgtatatatatacagtggaatatgaatgattaacagtaaaaagaacaaactcctgtggctactataagatggataagtcctgaaaacattatgctgattaaaagaagcatatgtactgcgtattgtatgattccattcaaatgaaaagtccagaaaagccaaattttctagagacaaagagcagattgcctggtgattgaattttacctatacaatggctaaatttttaagatatgaacattacacccccaaaatgagagacatggaaggagtaatcagagccatttccagatgtaatctcagcctcttaccatagggatgatatggactggaggaaattctcaagaatgtgattattttaattatgatgggaacaaggtaactataaagaatagaaaacaaacattttagagataagccctgattccatttctgtattgaatttacagataattgtttagacactacttttgatcgaaataacatatataagctatttagacttaaaagaaaaagacatgtagaaagtttcctctagttgaacaaaaccttcaactgctttctgtattcctattttgactctcgaaaagaaagaaaatgaaaaggcaaacaatgggtgaagagcttttattcaactacattcttttacctgatatgttttaggttcaataaaagccaattttatgagtttgtggatatatatacacacacacatatatacgtattgagcattgcttgaatattgagacttttggaatgatcaggtatagtaaaataaactctgatatagaggactagaaagaaaaatgactttttaaaaataaaacaggtgcatttgtactttgaatgtacagtgtatgtgtcacatgtttatatgtgatacttatgcacattacttatatacgtatttaatgttaaacatgtaaaatatacacactaagagtacatgttttgtttatattttgctaggttctcatttaatcacaaggaatattaacctaattaaggcacaacattttctttttgccatattctaacagcaaagataaagagacactccagtgtcatgttatatgtatgacagatgcttacagtcaacaattgccactgcaaacagcattggttagcaactgtattaaacttagacgtactgttggtgatttgggtggacttaacagttgtcaaaatttggggtaagtcagttttcatcttgtgagtttgatttttttttttttttagtctgggtcatgctctgttgcccaggctggagtgcagtggcacaatgtggtctcactgcaaccaccacctcccttgttcaagtgattcgtctgcctcagcctcccaagtagctggaattacaggcacgtgccaccacgcccggctaatttttgtatttttaatagagctgtagtttcaccacattggccagggtggtctcgaactcttgacctcaggtgatccacccacctcagcctcccaaagtgctgggattacaggcatgagctaccacgcccggctgtgagtttgattttaatataaagttttctaaccacatgaaagagtttctattgttttgattaccatggctataattgatctcaatttttttcatgcaggcaatattagcattgtgatacataaaatatatactcaatttaattctttgggagtgaccaccagctctctccttaactgactactctctagggataaaaaagcaatttgaggaaatttgggccatgtaaagatattgtaaacatcaaaattgtgagaaacaaaaactaaatataatatgaattcaaattgtgtgtgtatattcacataaaatctgtccaacttccaacagttgaatgactggaattatttctaacttctgagatttgatattggttctatgactaaagaacaagctggaaaggactaccatgttattagaccacccataggtaaaattattttcaaggcttacatagtaaaacatatattttatatatatatatacacacacacacctttgtttgcattattatactagatattgtggctataaaacagaatagaatatgaaatttgtcctcaaggatgtaaaagtacatttatctttttctttcttctcagaacattgtaataaatgtagtacattttcctctgtagaattagtaaccatagtattcatttgaatattcagtggtaatgtgagtttcaatttttagctttataggtactttctagtgactgatataataggtttcagaggcccattaactctacctggtgtccacataagtaatcacatactctgttgtatgaatggcttacatttttcataacgacctgcaaatataaaacctttctttctctccctattagttattctctcttggcacgtaagtagaagagacataatgaaataccaggagttttatctatttgaactcaagtaatatctcccaaggtgacattcccatgggtaaaaaagcagtcttcttcatttttgtgttttaaaacacttatttagatctagacttaagtgttgcttttcttgtaggagtttgaaaatgcttaacagtctaaagttaattattactctttacaaatatattcaagtttctcaagttatctaactggctattcttcctggctggttgcctgtagattttcttagaaaatttgctactttgacagggtagagttacatgatattgtccctactgttgtattctggatgtctctcatgctgccctatcagaatcccgagaaatggcataggaagatcactggagggtacactgagcataaattgatctggctactgccaggtcttgagaatgagaagagggaagagttgctgtgtatgttgagcaattaaagtactatcaaatgaatctgatcacaacatattgcctggaaatatgctatattgctatggcaaagtctattttgtatatgagattgattgttccacatgagggcaggaacttgtctttcataatgagtcagagaagtgacaatttctcgttatatttcagagttatgggggattgactatagtgtgtattctgcagatatgcctcaaagataaaaataaattaaatgcaatggaaacgtgttgatgaatttaaaaagttgttatttaacctattggtatttattagctcccctgtggcttctatgttgagaataaaaagatgaataaaacaagtttacactaatatcttgtcatctcaaacgctcaaaatagtcagtcttaaatgactgatttgatgcttttttttttagtaaaatttaaaacctagtgactaaaagggcattctttggagtggcagagatgttctatgttttgattgtgatggtggttatatgcttgtatatatttgtctattaaattttccattaaatactgttaacatgggtagattttgttatatgaaaatttgactcaaagtaagttgatgttggtcaaaaggtgcagtttcagttacacaggatgaataagttctgaagatctttcatacaacatggtgactatagttaaccgatatcatattttatacttaaagactgctaaaaagaatagattttaaatgttctcaccacacttataagcaaaaactggtaactctgtgaagtaatggatgtcttaaccagtttgattgtagtaatcatttcacaatatacaggcacatcaaaacatattgtacaccataaatatatacattttttccaactatacctcaataaggattagaaaataaataaaaatggtttattttctctctcattatataatagatgataatgtgtaccagtactgctggtaaaagtattataaataatatttgctaatatatattaatgcagttacagattattttccctttgttccgatgttctgattgtggaataattactgagtatagagttaattccaggcttgctctttctctctgtttctttcttctctttcactcacataaactaaaggcataatttaataaatgccctttcgtgtggacctttggaatgtcttttattccattaaaacttagagaaattgaatggtattttaggcctttaacacattgtttaatttactattttcttctaaagaattgggatttcaacaatccaaaggtgcctcaagcttaacatgttcaaaattgaactccctgttgttcctcactaacttgtatcttctgctctccaaacttctgtgaatgataccgtcacttaccagtcacacaagacagaggtctagaattcctctatgcctcccttttcctggtcctttccctatgaactgtattccagtcccatcagtccacctccttgacacttcctggatccattcccctggagttactgttgtgcttccatcttaattcaggctccatttatcttttacctggcctactgcttttctacaattaatacttctgcagcagcaaggtgatcactacagtgtcaaattggttatgtgaactcctaaagtttaatcttttactaatttcccatttcctaaaaggttagaatccaaattccttggtatgacacacctccatggtatgacatggaggacaaggtcctccatgatatgaagcctatccacctcttcaatagcaattatagaacccgaccatatttaataagtttatttaatattgaatacagaatccgaaaccgtaataggttgtctcacacatatataaaataaaagtattataaagaatatttgctaatgtatatttatgcagttagtgattattttccctttgctctgatgttttttgtttttgttcctgcttttgtttgagagagtttcactctgtcacccagtctggagtgcagtggcacgatctcagctcactgcaacctctgcctcccaggctcaagcaaccctcccacctcagcctccccagtagctgtgactagaagcacatgccaccatgcccggctaattgttttgtatttttagtagagttggggttttgttatgttgcccaggctgctcaaacttctgagctcaggcaatctgcttgtctcagcctccgaaagtgctgggattaaaggtgttagctgctgcgcccagcctataatttttaattaatttattttctctatctggaataaccttacacaaaaagggtcatctagtgaaatagctactctgtgccagtgtcaactgcatttggaaattactcatattcctctgagggataaatgaccaactcttccttataccactacagcatcctatttctatacatgcattactttgtaagttctttgcagagcatttccataactgattcagctctgagattcctataccacacctggcatctgacacatggtaaacaccaaatccttgacaagttactgactactatttatattttatgtgatttatttaagctgaactaattatgatgctttcaaaatttaaatgtgtatagttttaacatcaatgaaatccagaagagatagttgaaggaaaggtttctgaggtttttaggatggaaggaagcataggtaaaagatcataaaactgtcagcagctttttaaatatatagagtgttacataaacacatatctgtccataagtagtgatgccataaaattgtctatccttcacctcaaatacacaaagtgtaatttattttttctttaatggatttggtcttccttatgtgatgagtattgggatatcatactttattttggtccatttgcgtctaatctcacattagtctataatgctgtagattcaagtatccctttaggcagtgctgactttcttggttaaaaatcctgtctctcaaccagtacctctctacctccttaccctaaagtggcatctgagggaagggttgacttcctaacctcttagtgctgagataagatccctgcattgtgatgccctgcgacaaatgtgaattccttttctttttttctcctatattcctgcagttgctggtctctctgttggtcataatggctgagctcctaaactgtttgagtccagagtggcatatttcttgtgtgtccagtagagactggtggtcctctcttgcctacccaagctcttcgtggctcatgatggtgacataggctctctgaatcacggcttcaattgttatagggtcctcactgttcaacctccaggccactttgccggtccaactctactctagattaccctgaaatgattcaaatgataccatgtgtctgtttccattagtgaagggtgatgtgatagagcagtcccagtcataatgtctttggagctagaacaagaatataaatggagattattagttttacattaaatatttaactcatgaatcaatctgacagtttgttaaaaatatatgctatccttctaccttgacaaaaatatcttcttaatggtctggagagccagatttgaattgagaatcatctgactccttaaagttctgcagccaaaaaaaaacacaaacaaaacaaaacaaacaaacaaaaaaaacagcggtacaggagaactagcacctgacacctgccctgtgtctaacactaggttttttttcacccctgaggctgttagcatcttgagagcttcaaacaaacatgtgtgaatgccccagcctgtatgttgaaactgtttacacatgctactcctcaggcccagagatgcccatataggtggctcaattcattgcaaagaggaaaaacccagggaatgaactctcacagaccagggcagagggcttggagaggaatgttcagagtcctgggtagggatggattccagacaggtataatatcaataggtaattatggcctccccttggccttatggaatccttgccacatgagtaggagtgagctagaggagggagagagaaccctccaacgtgcagagactgggtgtccttgatctaaggttcatacttactcagttcacagttagatttccataatctcaagtctaaaaggctcctatctaccaacgtcctttcttaaggtcttctgtttaattataccatggtctcgttctccttttatattcttaaaaagaacaagtcactaacacagtctgcctgggaacagtacactttttggtaacatcttagagcagaaaatatatttaaaaagcaacaatataaagaggaaattaattttctttttgtttcctaagtattacttaatacttacaatatatttttcctattacttatataggtattgccatcgacactttgtaagttgtagtaatacacactcataaattcagcagttaactcctctagctttgcacgtaatgctgttatttcttttaaaacacacggttatcctattacgcatgtgaagcttggaataaaatatatattaaaatatgactaaaaataaaaacagattttataggctttggaagtactatactttaaaagatctatatttttcacactgaggaaggagaactactgaaataaagtgtactgtgtcaaagtattacacacagaatatgagaatggcaatattgaatatccttgcccaactgtggaaaattaaggattaagatttgaggaaagtctaaatgcgttaaaatggaaaatgtaggccaggcatggtggctcacgcctgtaatcccagtactttgggaggccaaggcaggtgtatcacctgaggtcaggagttcatgaacagcctggccaacatggtgaaaccctggctctactaaaaatacaaaaattagccaggggtggtggcgcatatctgtagtccagctactcgggaggctgagacaggagaatcacttgaacccataaggcagaggttgcagtgagccaagatcgtgccactgcactccagcctgggtgacagagtgaggcttcatctcaaaaaataataaaaataaaataaattgaaaataataagcacaacattttgtcatttagttgataaatctacagtttagagtttgccatgagtcaaacactatcgtttcccaagtgaattaactttcataataatttgcctttttaaaaatgataattacccattccataatgggtaattacaggtaactatattttaaaagaactcactattactgtttatgtatctactgatttgaaagtgaaaatgtaaaaatgtttttatcaacatcaccaagatgtttttctacaaattctaactgaattgtattctactctataaactgatagacctttgctttagaaacttatgtggaaataccaatccagagaaatcctgtctccctatctcccacctgggactctttagaacctttagtattcacttcaaaacgtctgatatgggaattatagtgtggtgttctttaacttttaatatcacagatcccataatttggagcatcatgtaacattttgtagagctactattcctcagaacacaatttgagaaatgttctaatagagtcattttccacaaataggaaagtcctacaaatattattatactaaatcataatgaaaactagtctgatttgatgtattaattataaagtagtttagattactttaacttttggtgattattgccaaaacttctttcctattaagagtattctacaataaattaaatttagtccacatataatgctgatcatatgtacagtaacattaacatctaagatgacagagtaatatacatcttattacttttgtgaaaaatagaaagggttacataataaaatattaattgtctagaatttggctttctagaggcttgatatactgtgatgtagcccttaaaatatggatgttcttgtcagaaatgtagttctatattgggttctacttttgttgtcagtatgactgggacaggttactggatctctttaggtttgtttactcacaggtaaaatggtggttaataatatcttcctggaagagttgtgatactaaagagatggcctatatatgtaaaccacctggcacctggtagaagcattgattactcttctaccattcattttctttgaattcaattttttttgaggaagtacttcttggtgacagtgaagttccttaaccctcaagaaaaagagaaaactcagattcttggaggaaagaatgtagcactctcttttaccttgttataaaaggttaaattttcccttcagaaatttggaaggcgtggggaaaatttaagggagcaataaagaagaaaagcagaaatctgaacatagatgacaataaaaagaaatgataaatacatgcatgtacactcatgcatgtttgcacacacacatgcacatgtgtacacatgcccaacaaccacaaacacatccacaaataaaacaagagacactggccaggggcagtggctcacgtctgtaatcccagcactttgggaggctgaggcggacagatcatgaggtcaggagttcgagaccagcctggtcaagagaccagcctggccaatatggtgaaaccccatctctactaaaaatacgaaaattagctgggtgtggtggtgggcacttgtaatcccagctactcaggaggctgaggcaggagaattgctttaacccgggaggcagaggttgcagtgagccgagatcacaccattgcactccagcctaggtgccaaaacgagactctgactcaaagaaaaaaaaaagagacactgaaaaaaagagaaaattaactgtgatgctcactattcctgtgaggttgatttaactgctacctgcactgcaatttaatatgatgaacttaagagtacaaggcatctggaattaatctgaaaaattattattagaataatgacacttgaagtgttgacttttgactacaatggaatatttattaactagaacattctgcatacaggcaggaccttgtgaagcaaaatttatagctttgtgttcaggaatgattacaaacaaagatagcagaatcagggctttattagagtactatgcaacagttttgctaaatatatgttaaaggaatctgaaagaataaagagaatcatgaagattatcctaaggattctcctaaggaaattgagctttctgtgctacccagagaagggcccagatggtactggattcccgctgtaacttaaagggaagcttttacaatgtctggaacctgcgatgtcttgaaaatgaaggtagaggatgtcctcaagtttcttacagcaggaacccacttaggtggcaccaaccttgacttctaaatggatcagtacatctggaaaaggaaaagtgatggcatctatatcctaaatctgaagaggactcaggagaagcttctgctgaccgctcgtgtcattgttgccattgaaaactgatgtcagtgtcatgtcctccaggaatactggccagagggctctgccaaagtttgctgctgccactggagcaactccaattgctggctgcttcactcttgggatgttcactaaccagatcctggcagcctttcaggagccacagcttctagtggttaataatcccagggctggccactgtcctctcacagaggcatcttttattaacctgcttactattgctctgtgttacacagattctcctctgtgctatgtggacattgccatcccactcaacaaaggagctcactcagtggggctaatgtggttgatggtggcccggggagttctgcacttgtgtggcaccatctcccatgaacatccatgggaggtcatgcctgatctctacttctacagagatcctgaaggattaaaaaggaagagcaggctgctactgaaaaagctatgaccaaggaagaagaatttcaggatgaatggcctactgtagctcctgagtttgctgctactcaggctgaagttgcagactggtctcaaggtgtgcaggtgccctctgtgcttattcagcagggctctgctgaagactggagcactcaagactgccacagaagactggtcttcaactcccacttctcaggccactgaatgggtaggaacaaccgctgagtggtcttaagctgttctttcatagatactttttttttttttttcctcctgagacggagtatcaccctgttgcccaggctggagtgcagtggtgcgatagctgactacaacatccacctcctgagtagctgggattacaggcgtgcaccaccatgcccggctaattttttgtgtctttagtagagatggggttacaccatgttggccaggctggtctcgaggttcttaagctacatggcaataaggttgttggaaaataaacattattgtctaaagaaaataggaaagtgaaatataaagttatgaatttaaagctatttagaagggcatgaagaaagaccaaagaagtattcaaactgaaattattctaaaatgaaatttcaaattaaatttaatctagtttcacattgctgattaaattttagatgacactgtacaaagctatctgggagagtgaaaccacatgacaaatttactggttgtcattttctactttgtgattttagcctataatcagttttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagactagtttccgaggctgagcatggtgggtcacacctgtaatccgagcactttgggaggccaaggtgggtggatcacctgagagcgggagctcgagaccagcctgaccaacgtggagaaaccccatctctactaaaaatacaaaagtagccaggcgtggtggcactttcctgtaatcccagctacttgggaggctgaggaaggagaatcacttgaatccgggaggtggaggttgcagtgagctgagatcacaccattgcactccagcctgggcaacaagagaaaaaaaaaaaaaaagaaaaaaaaaaactagtttctttaaaatgtggatatcagttaaaatctgtgtattgtattgcattttgaatgcactggattaattccatttttaaatgaaacgtggaaaatcttgttttaagatgaagaatccttgctaaatagaatctctgaaccctaaaatggcttttttaattgggaattttcaaaatatgaatttggttagttacaacaaacaatcaaaatccttacctatgaattgccctcttctaaagcaagaatgttcaactcggatatctagtggtaaagcaaaaagagatttccctgttagtcctcttacaggttgtgggcattgcttatttgactttgaaacattaaagaagaatgtgtttcagggcagacatgttggtaaaactgtttctgttacaaaaattttagaggacaacccaacgttttaatgtggtgaacctcatttatcatcctgtcactgcaccatcttttttcagtttcatcctggaccagggtttcatggcacagaaaaaaacctggccatcaaatcatagcatatgaacaagtagatggccaaatgtttgaaagcataaacatgcctctctcattgggcactggttgagagggttcgaagcccattatttgtaattgcagttcagactaggagaaaaaaaactccatccagaagagaaacgattggaatgtttgtatggatttgggttttgatagcttctgtaacattccatcactgtttgtgtgagcattttccaatcagctgtcccaacatcaaagccatttctgcataatttttttttctctatattgcttgttcttttcaaaatttggttttctatccccttctcccccagtctcagtgagatttgcattttaatgtatgatctgtctaatgtattgtctatttcacttctaacagttacatctcttacatttacaaatgtacttcaccatatttcttccagacagtcacctttcttattattttactgccctcatgacataatattgtaactatctgcagctcttggacaaagagaacctttccagaagagctttcaactttttctcttttgccttggagtatgtctctctacctctattatgttcttgtaagtgataaatatcttatgagttttttttgtctatccataatgataatagaatctgagcattaatatttattttggtggaccatgcacaatttctaaaatccataatttattttcataaccaatattacagtaaattcattaagcatatacacggtttggaggcttattggcttaataggttcaattcatagaaaaggataattcactacctactcaaaagcatcctaccttgagagtcagctaagtggggaaaggaaaaatatgcttttctcttcagacagcctttgtatcagtgtttcagtaacatacatgactacttattgccatttcatttcttctctttgaatattgcctttgcctctcctgggacagtagagttaatcttataggaatacctaattccacgaattccttagaatagtataaggctgtgcagtgattggcccttaccttgctctctggtctctccttccaccaccggcttctgagaggttcgcagtcttacatcttgaaaaccactttcagtttgtgaaatggaccaggattcttctttttcttttctttttctctcttttatttttttttttgagacaaggtctcacactctcacacagactggagtgcagtggcatgatcattgctcactgcagcctctacctcactggctcaagcgatcctctcacctcagcctcctgagtagctgggaccacaggcatacgctaccatgccagactagtctttttttgtttgtctgtttttgtttgttgttgttgttgttgttgtttagagacaaggtctcacgctgttgcccagactggtcttggggtcctgggctcgagtgatcaactgcctcagcctcccaaagtgctaggactgcaggtgtgagccacttcactcagccagaccaggattctttcaagttttggtgacattacttatatttttccctatttttggaatattctccccatctgattgcactggaacagctttctaacatttttttcaaggctttgttaaaccataaaattaaaaaaataaaaaaacattccttgagattaattctcctggctgtgttgtgcaatccttctaggtgcctgcatgctctgtgcttatctttaatgataataaccctttatgtgttttaaatcatttactcattctgacaagcatattcagtaaacaactgtagttatcatcagtcctattttatgaatgtagaaaataatgcaaagaaaattaagttacttacccaatgtctcacagctaatggtagaacaaattttgaagaggtctgtgacaggactgtccattagaagtcgaatatgaactaaaaatgctatgcaatttttaaaaaatttcaagtagatatattacaaaagcagaaagaaacaggtgaaattcattgtactgttattttattctcaatatcatttcaacatatgacctataaaaatgagattttttttatttcttcacactgagttttcatatccagtgtacattttaaacttaaagcagatcttgattcagactagcattctagaacacatgtgcctaattgctacctttgttcaacagcacaagtctttactcttaattacagcacccctctttgtattgaaatagttttatttgcctacctgccccattctactgtgtgcatctttactaggtgaagaatgtgctattcatttctttatttcaagtatatagactagttagtgcctaagatatagaaacaataaatgcttatggaattttgttgctgcagtattgcagtggcttcagagtacagagatttttggatactctttttagcaatcattgtagaattgaaaatctaaaagattcaaaacgcttgacaaaatttctagaaggcatgtatttgcctgttagacttctgagcaggtcatacaagaagattgggaagctatcctggaagttagctgtagcccctacagacagtagaatatgccaagtttccactttaagagtgcatgtaaatgctatgacttttactaaaaccacatggcaatataataaatgaaaatgtggtctaaacgtgttctggaacatttcctaattattataacatattgtattttgttatcattatttagtagaaaaatgggatcagaattagcattgtaatattattttggtaaaattatgaatgggatcatgcctcatacatagtagatgcctaataattattaatctgatttgatttatttgagccagggttagtaagttcaacttctactggtttctgttatttatttgagaacctattcaacttgccatcattgggacaagctgggacagttccttaaaatgaactctattagagtcaaattgttccatctgttttccctaaatgaaagaagattcccttgatgctagtcaatgagtgagggctccttgactcagaaccagatgcaagctttataccagccttccatttcagcccaattacattcttggcagcctgtgagactcatggggtaaactttttataacaattatcaatatcagccaatttttcagaatgggcaggaataaacttcaatggctccaggatgagttttctgtcttccaaagcctctgtctggctggctgccatggagaatatgtaggagcataaaggctgctgttttatgtaacactctagaaatcagctaactttatgactacttagagttttaggattttatcaatctaaattaattatttaatattggcttaggctacttttttgtgacatagagaacattatttttattcctgtgatacagacctccaaggtgtgtgtgtacattacatagcaatgactggagtctggtttattgttgactccctcataaagctattgtggacgaaagagagaaagcatcttactgatgggatatagaatcagtgaaaacctggaaccattgaattcccattgggttagtgtgtgtatattaggatgggaggtttggggaagtagagtggaaattgatggtgttatgagatgacgtcgtgacctttaactcaggaatgactcaatcctgtcaatatctaacaatccctatacattgtgatctcaggtagattgttttgcaatggcaatggcaattatgaacacacactattattcactgaatgttcataatcacaaagggaaattgtttcttaaattgcaataggacaccaagatttttctcaaggttcaagagaaaacttttctgttttgagaagtttgaaaactaaaacaaagaaagcattcatatgataagagaagaaagtgagaagacacgagtcctctgtcctcttagccaggctctaatgggttcagcccatggaggtaggaattagaaaacatcatagaccatatcgacttgaactgcttagaaattcagccacagattttctgaagcgtgagaacggactaatacaaaaaatcacttttgttatgcattagcaaagaacttggaggcattttgcccatgccttatggatctttggaactttgaacttaagagtgatggattagggtatctggtagaagaaatttctaaggagcaactgattcaagatgtggccaggctgcttctaaaagcctatattcgtatgtgcgagcaaaaaatgacctgaaactggaacttatatttaaaagaaaaacagagtgtaaaagattggacaatctgcaccctgaccatgtgatagaaaaaaaaaaaaaaagcccatttaacagggaggaattcaagcaggtggcagaaatttgcataagtaaagaggagccaattactaatagccaagacaatggggaaagagcctccaaggcatttcagagacatttgtggcatccactcccataataggctcagaggcctaggaggactgaatggtttcatgggccaagcccagggccccactgccctgttcagccttgggacactactccccatatctcactctgctccagctccagccagaaaatttgcagcctagtcatttggtagaaaagaaaagccatttgcaggggaggaattcaaacaggctgcagaaatctgcataagtaatgaggaaccagttgccaatagccaagacaatgggaaggccttgaaggcatttcagagacctccatggcagtacttctcctcacaggcccagagacttaggaggtctgaatggttttgagggccaagtccagggccccacggacctgtgcagccttgggacactactccctgcatcccagtcacttcaccactagccatggctcaacaaggcccaggtacaactcaggccaccacttcagaggatgcaaactgtaagtattggtggcttccaagtggtgttaagcccatgggtgcacagaatgccaaagctgagccttgagagctcctgcctagatttcagagaatgtatggaaaagcctggatgtcctggcagaagcctgctgcaggggcagagccctcatggagaacctccaggaagccaatgtggagggaacatgtggggttggagtccccacacagaatccccagtggaggactgtctagtggagctgtgagaagagggccaccatcctttaaaccccagaatggtagatccaccagtagctttcacatttagcctggaagagccacaggcactcaacgccagcccatgagaacagttgtgggggctaaaccctagaaagccacaggagtggagctgcccaaggctttgggagccctccttttgcgtcagtgtgacctggattgagacatggaatcaaagaagattattttggagctttaagatttaatgactgcttttctgggtttcagacttgcacagagcctatagcctctttcttttgaccaatttttccattttggaaagggaatatttacccaatgcctataccaacattgtatcttggaagtaactaacttgtttttgattttacaagctcatatgcaaaaggaacttgctttgtctcagataagactttgagttaatactggagtgagttaagactcggggggactcttgagaagatatgattgtattttgaaatgtaagagagccatgagatttggaaggtgccaggggttgaataatatggcttggatttgtgtccatacccaaatctcatgtggaattgtaatctccaatgctggacctaaagcctgatttgaggtgattggatcaacagggcagattttcctttcgatgttgttttgtgataatgagtgagttctcatgagatctgatgttttaaaagcgtgtggtacctctccactttccctcattctgcagccgtgtaagacatgcctgctccccctttgccttccaccataattgtaagcttcctgaggcctctccaaaagtagaagccactatacttcctgtacagcctatagaactatgagacaattaaacctcttttctttacaaatcatccagtctcaggtatttatttgtagcagtacaagaacaagcaaatacagagagccaatgcatcacatggccagagtagaagcaaaaaagttaggggtaagatgccacacatatttaaatagccagatattgtaagatctcactatcatgaggacagcaccaaggatatggcactaagcaattaatgagaaacctgccaccataatccaatcatctcctaccaggctccacttccaacattggggaatgacattcagtatgaaatttagagagtacaacatccaaactgtgttaatactgttacagaaatactcaacaaaatactaacaaactgaatttagcaacatgtttaagagattatacaccatgacccactgggattattcctgtgctaggatggttcaacatataaaaatcaatcatgtaatacactacattaacagaatgaaagataaaaattacatgatcatcacaattgatacagaaaaaatcatttaataaaaaattaataccctttcgtgatgaaaactctcaacaaactaggaataaaagaaaactatttcaatatattctaatccacacatgagaaacccatagcacacattactcgcaatggtgaaattgctgaaaaattgtccttgaagatcagaaaaatgataggatgctcacttttgccacttctattcaacatagtactggaatttctgatcaaggaaattagccaagaaaaagaaataaaagccttggaaactggaaacaaagaggtaaaattacttctgtttacacatgatgtggtcttagaaaattttaaagatttccaaaaagtttgttagaactaattaaaaacaataagcaaagtgacagggtacaaagtcaatacacaaaaatcagttgcattttgatacactaacaaacaacccaaaagaggaaattaagaaaacagttctatttgtagtagcaccaaaaggattaaaatatttaagaatttagttatctaaagagataaaagtcttgcatacaaaaagctacaaagcattcctggaaaaaaaagatatatattaatgaaaagctattccacatacatggattgagagacagtattgttaagatgccaataatgtccaaaacaatatacacagattaatgtagtccttataaaaatcccaatgattttttgcataaatagacaaacccttcctaaaacttatatggaatcttaaggtatccaactaatcagtacaatcctcaatatagaataacaaagcattgagctcatacttcatgatttcaaaatttactgcaaagccacagtaatcaaaacagtgtggtaatggtgtgttagccctttttttgtgtgttgctattatacatataaagacatacctgaggctgggtaatttataaggaaaatgggatgtataggaagcatggtgctggcatctacttggcttctggtgaggcctcaggaagctgtcgatcatggcagaaggaaaaagggtagctggcatctcacattgtgagcaggagcacaagagtaggggcaggtgccacactcttttaaacaaccagatctcatgtgaactcggagtgagaactcactcattaccaaaaggatggcactaagccattcatgagggatccagccccgcaatctagtcagcttccaccaggccccacctccaacactggggattgcatttcaatgagattgggaggggagaaacagccaaaccacatctattggcataacaacagacatatagaccaatggaatagaatagagggcccagaaataaattctcaaatatgtggttaacttattttcaacaagggtattgagacctcagtgaggaaaagacagtactttcaacaaatgtcattgggaaaattgtttatctacatgcaacagaatggaatgggattgttaactaaaatgatgtttaaaaactagttctaagtgaatctatcacttaagtgttaaacctaaaactataaaacatttagaagaaagcaggacaaaagcctcaagatttgggtttggcagtaatatttcttggaaatgacatcaaatgcacagacagcgcaagaaaatatacacaaattggacttataaatttttttaagtgtgcatcaaaagacatcatccacagagccataaggtaatccatagattgggaagaaatatttgcaagtcatatctatggtaagggattaatatccagaacatatagaaaatgcctacaactcaacaagaattacaaaacaaacagcataattgatagacaaaggagttacatgaatatttttccaaaaagatatgcaaatatccaataatcatgaaaaaagatgctcaatgtcactaatcattaggaaaatgcaagttaaaaccacaatttgataccacatcacattcactatgatgcatactatcagaaagaaagtaaatagaaaatatttggtgatgacgtggagaaactgaaagtcttgtgcactatttggtgggaatgtaaaatattatagctgctgtgggaaacagtatgatgtttcctcacaaaattaaatgcagaattactgtatgatctataaattattcttctggataaatacccaaatgaattgaatgcacggtcttaaagagatttttatgtacccctattcatagcagcattattcacaaaagctaaaatgtggaagcaacctaagtgtccattgatggatgagttggataaacaaaatgtgggatatacatacaatgggatgttattcatccttagaaaggaaggaaattctgacatatgctacaacatggatgaaccctctaaggttcatccatgctaagggaaataagctagtggcaagtagacaaatactgtatgactttatttatatgaggtacttagagcagtcaaaatcatagacacagaaagtaaaataatggtttccaagaagtgcagtaaggaatgaagagttactgtttaatgcgtacagattttcagttttgcaagatgaaaggggttctgaagataggtggtggcaatggttatccaacaatatgaatgtacttaatactgctcagttgaaaacttaaaatggttagtatggtatatgataaattttatattgtgtgcaatttactataattaaaaaatgaggaagaaacacagtttaattttaaataaaaacacacatgtatatatatatataaatttttgatgtgataaaatatggtctcccataagaccaggaggacttaatcaaatttgctccagctttatgaccttctttagcccctctgaaagtcatcactccatatttgctgaggttcgaagttgggtgtgcaccagtctggtagagactagctccacttttagccatatgctgttgtgctgctaccatggtttctcacatttgttaactgacactgacaaggctgaaagaagcagtggcatgcaccttgcaggggagacatgaatgcgtccacacctgaatttgccatgttcagacctcagttatttcccctaatagaacaaattctgatagtacgaggaatgttgagagctaccccttcaactatagcctctgggtgctgcaggccataaccaggtcgggtgtgtgctataagggggtggagatcaagcagcaccatcccctggggcagctattaaaattttcacttccaaattgtatttaaagtctgtctcccattggaattctggctcccccgttctcttaattgtatgatgttagtccacttaattaagttccctggagttcaattttctttatgtaaatataataattttgtttatgtaaatataagaattaaatgagataagtataaatgtctaacaaaatgtccttcccattgtaggtgttaagaaatggccctttcttttaatgtactgcataactgaatttttttcttactgactaggttataggtgccttttcccctcctcgttcctacttcctagggacatggtaaacacttaacaagtagtttattgagattgaaaaaatgtattcattctattgttgcttgttggttctatcagaacactttgataggaacaaaaatggtgattttctatatcatatctgtatctttgaagacagttatctacccttttatcatatttgtgcttccagctgtgccaagagcaaatgttatagagttaaaacgcgggtgaggtgaggcaggatctgcagactgtggctcttatctgcttaatgatgtgtacagtaagtgtcatattaggaagaagaacaggaaggctcatctttttgaagcagaaacataatgttcagtataaagaatctcatatcatgttttctaaaaaattgtatgcgaaaaaaatggtgaaataaaatgcttaaggagagacatctgttctctctgattctttaacccactttagacttggagaagcaaagaaaagcaacagtttaattcttgtgtttctttaggtccagatctttagctcttgcataaaagtgagcaagctgccatctgtgcaaacaggtggcttgaattaaatatgatgctaagtattagaacaattatatttctagcatggcaggaagtgacaaaattaagaaaacccagggtacttttagtaagatgagatatgtgagccataaactgtgtctaagaagataaagtatgaaaatatatgttcaaaaggagctaaacaactgcatgcttcacatttgcctccagtaattcaagaagagatgaagtgcaattactcatatgcccctttcaacatactactgtgggtcaactgggtccatcatagaacagtattagggaagatcttctatgtcatgaataaagagttgctcaactgtggcttaattatcatttaatagtgactctcttagcttcataaagtacattcttcaaagcttgaagctaagtagaaaggcaaaagaacacacaggttggagggtaagcttaaggaagcagtataagcatcgttcattcattcagagataaccggtattgcagtaagtaggctggacttggaatcgtaattcaggagttttagttgctgattcttcactgggttcaatgaggcttttttgatgactttttcatcatggatgaaatgaagtcgttggacaagatgacctccttggttccgtccagctctacaaaacattttggagccaattattttgtcgacttttttctcaggggtcctttatagaaacagtgtataaaatttactgataaagtaattaactctttttgacagttttccttcagttagattaatattttcagggttcatctatcttgtactatgtatcattatttcattctcttttattgataaaaatacttcattatatgaacatatcacctgcatatgattaatgtatttaatattgtcaacttattcagaatataaatactatttgtagagccctatattagtagaggtaaggatgagaatattcaaattaaatgagaaggattacacatagcaactataacacaagaacaaaccatttttgtttcaaagttggtaaaaagttaaactttacttggagtagatgaaacaaataccaggcaaatggcacattgttttgtttcatattacaccagtagtttcggttttacagccaaaatatatctaaagttttgtatttgaaacttttgtcatctcagttgtttccgttttggtcatcactattttttcatatacctttaaaaaataaatttattgatataaaatcatatagcataaaattcacccttttattttttaaaaataatttttattgtgtctatttaatgtatgtatacatcataatgttataagattatatatatatatatctgcatacatagtaaaatagttagtataggggaacaaattagcatattcatcatctcacatagttacccattttttcctccttgtgataaaaacagctatgaaatttgcctttttaaagtgtacaattcattgtttttagtatattcatagaattgtctaaccatcattgctgttcatttctgaaatgagttcatcatctccaaagggaaatctagtacacagtcatttctgattttcctccccccagtctctagcaatcactaatctactttctatttctatggattttcctatttgaacatttcctatagattgaattatgccatatgcagctctttatgactgtcttctttcagttacattcatatttttaaggtttattcctcgtgtaccatgtatcattccttcattcatccttattgacatataaataccaatattattatatggatatatcacattttatcaattaatcagttcatgatactgggatggcttcctttcatcatagccttactaccttaacatcttcttattttttcttttcattatgtgtgggtgattaacctctgggattttactctattcttgctttgttgtctcatccagtttatatatgaattccaaaatgctcaaaatgggaatacttagacactaattcaatgagatacataaataccaaatatatactcagtcttattcaaagtaattgggtaaataaggaaattttaatattttcttctaaaaagagtacacagccattttgatggttaatggtagtatctgataacaggatgaaatgtaggtagggtggagaattaaaaaatgcttactaaatcatggtagttacgttacctccatcatcatcatactcaagatcactttattggatacatactctgtggaaggtacttcatttttaatatgtattatagtatttgatattaaaacaacttattttggacatgtaggatttttaaaaaattatttcagatgacaaaagtaaattacagatagctaatgtaaccagctccaaaattaaatactgttatgtagaagagtcagaatttcaacccaaatctctgaaacatactccttcttcgttctttcactgcctgatatgtctatctgtctgtctatctatctatctatctatctatctatctatctatctatctgtatgtgtatgtgtgtgcatttgtgtctgtgtgtgtaaaactaatattgtttgggaggaattcataattcatagaagaggtggactttcaaattgcccatgatgttagatgaggaaaatttggttaatcgtgatgagaagtgaggcagggtcactagtttgaagaaaacaaccacagcaataaaaaatgtactctccacattcatgttctaacactgattgatgttaagttgtaggtttagagttcagccttactggcagacttacttgtaaattccgactgctccttggccaatctgattattcttaacaactcaacaggagacttgaaactttaatggagatttgtgattctcccagggcgtatatctatatcttctcagcagtgtcagactgatctgctgccaacatgtttttccccctctcagtaaaataaatctctgactacacatcctggcaaaagcacacatttctcctggcaagcttcctcaatgggcatcgaatatcttgagatttcagacaaaatcatttttctccaggggaaacatgactcgtgtagatgacaggaccccagacaaacagcaaactctgctcagaattttaacaattactaaaaacatatttcctatcacagactcatttttttttgccaccagtacaccccccccccacacacaaacacacaggtgcacacatacatgtgcacatagtcaattttcctgtacttacctgcattatgaaatgccaaacttatggtgagtttggagaggcaattttttttttttacaaataataccctccataaataaacatagttattatgaatgcacactcattgtgtaatagatctgtggtttgtgtcacttagccaactttgatcattttctgtcatccagaaaataacttctttcttaacaaccaacacataatcaatgcttggcagtaatgggcatgtgatttaggtttgtgcctaattagcacattgcataccactaatgtacagcacaggaatgagtacctggaccatctatgaccaatgaaagcaagggacctcctactgagaaccctggaaaatatagttttggtttttttatgttgtcttgaaagtgacaggctgtagggattccatatgctatagtcattttttgatcatgaagagaaagcttgtctgaatggagccatctgaaagaaaactatggtaagatattagtcatgcccctgatgacaacactgaagtatctgtatcaagtcatgcatgtctgcatgaagccctacatgcagtcagccagttcgggaggtaatctcattcaggcaggagtttctgatacttcaaaaagcaataaatagtcctttagttttctcccacctcctacctaaaatagaaaatggtaacaatgacttatctatcaattcttagctgatcatccttcttctaaaaacattaacttgtatatcgtgtcacgtgcctgtagtcccagctacttgggaggctgaggcaggagaatcgcttgaacccgggaggcagaggttgcagtgagctgagattgtgccactatactccagctgggcaacagagcaagactccatctcaaaaacaaacaaacgaacaaatattaacttgtataatagctgtttacagttaggtaagttacatcctgggcataagaacaaatatgattaagtccattatacaattttaggctcatcagcattttttcttaatcatctgaatttttctcataaactttaacactgttccaaaaaaaaaaaaaaaaaacaaacaaaaaccttaaagcctacatatgcttgagaagttattttatccaaagaaaaacgacaacctattgcccaaagttattgcctcatttccacttgctattaccttagaactaactagtgttttgatattagtaaccatcctataactatttctttgtaagtattttcatatattttatattcgtgcccttcattcttgggtctgattgttgttaagtatgtgaattttaattattctttctgtcacttcttttaatgttgtttctgtttaaatgaatgcaatactaccaatttattcaactaaatcaattttctatttaattaagtcttactttatggtttaattatatacttggattacagtgatcaatcttctctctagagatttaactgaaatatgcagaaattgataaaggtaaagttatgtcattatgcatttgaagagtcatagcatctgttgtttagatgtatgaattagttttccagacaacaaaattcttcaatactactctatgcaattatgttgagaactataacatctattaatatgttccttttgtctacattttaaatacagccactttttctttgtatatttcagttatgatattgcaatttatttttctttctataatgtcaactgagagtgttaagcttttgaaatagccaatggtgaatttttagtgtttagtgacatagtataatgcctaatctataattttaaggaataaagtctgatctaaaccttgatatgttcatgattgccactgtgtattttataagggaacatattaaaattatcagttagtttcccttgacatgtttgcattacacaaattttccacagtggatttatattattttaaaatcggaaaatataaaaaattattgtctttgacccatatgtctttttcttctatcaccttttgtatgtcaatatgctgatattaaccatgactacagaaatattttcataagggtgagaaaacttgcttaagttttactggcactagtaacatatccatctgtccattcaactgaaatgctaatgagaagacattgcatcttgaaaagaaagacatagctttatcaaagatgttggagattaaacatgtttgtcaattggacaatgtcaacaatgcagtttagatgttactttaaaataagctctattttctgcatgtatcactgcagtgtagagttctagacctttgggatcatataaacacatcaatctttatatttactttatatgagatgctcaagtggaagagaagcatgaatctgcttacatctttcctttgcctggtgatttaaatagactggaccattcaacaagagtgttgagtgtatgagtatgaagtctagaaacttttggtaagagttttaactgaagaaagttaatcagttaaagctggtggttatgctactattctgcaaacaacccttctggtgggaaaatatatttaaaattctagagagagattttattttcctcttatgctatctttttgcaaataatccaaagaatgaaatggtcgtgtgaaaattgctgctattcacattttagctacaaatcagaaaaacatcatttagttgagtggctatcaactgctccattatctagcctgaaaaaggctctttatcacaggaagtaccattcataggatcggcacttccacaagaattaataatgattacttacaattatgatgacttttaaataaaaacgaactttattctggttactttttaggtaaatgcttttattttggatatctaactttatcttatttaccagggatttgattcattttttaaaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtagccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacattaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaacaagacatttatacagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgcggagaaataggaacacttttacactgttggtgggactgtcaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactcctgggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaatatgtatctctcatgccatgttgtaaaacaaacaaacaaagaaacaaaaaacataccttttagagtgtatggctattttggaaatccaaaagaacagtcttttagttacattgcaatgatcggtgattaacgtttaaaatatagtaagtaaaagatatcttatttgaatgaggcaaacaattaataggctaacacagattccagcaaactttttatttaaagaaccagagggtaaatatttaaggctttgcgggccatattttctctgttgcaactactcaactatgctgttatagtgcataagcagccatgagcaataaatagatgtagctgtgttctttacaaaaacagttcttagaaagccagattagcccaatgctgtagtttatggacccctgatctagtatactgtaaaccaaaaataaaaccctaaggcccccaacagaccaaacagactctctcttggccaagaggaccccagaaaaacctgaaaacctgaattcctggctgtgatgggaagggatgttgaaccctcttctttatatctccttccttttggaatttaagcacaactgaccagcattcaggttaaaatagagatcacaagaataacaaaacagtccctttgtggctaattaaaaacaaataaaaggccatgcaaggcaaaggttaagtcccatcctacaaaccaaaaaattttgtaaaactggcgcttttttttttttttaaattaagctggtacaatttgacttaatttctaacctaactacagatagcagaccctgaaggaaacaaacatattttaccccaaaatatattttttgttatattttgaaatggccccacaaaaccatcttttgtagggaaaatttggatctgcagacaatctctattaatgtaaccagaccttccctttcccaagcctttcccagatctaggggagattagctgacagtctgacaactttaatgtctgaaaagagacatttaccatctattctctctgaggcttcatctgcataaaaagagccttggcctttacaaccccctttaatcttgattcaagcatttatttcttctgacttcaaatatttagacaaagtttaactcttgcaaccaattaccaatcagaaaatctttgaccccactgatgacatgtaaaccttccccacttcaagatatcccacatctttaggctgaacccaggtacaccttccttgtatttatttatagttgtattagcctgttctcatggtggtataaagaaatacctgagactgggtaatttataaaggggagaggtttaattgactcacagttctgcatggctaaggaggcctcaggaaacttacaatcatggcagaaggtacgtcttcacagggcagcaggagagagaatgagtgccagcaggggaaatgccagatgtttgtaaaaccatcagaccttgtgagaactcactcgctatcaggacaacagcatgggggaaaccacccccatgattcagttacctcctaccgggtcccctgacacatggggattataaggattacaattcaagatgagatttgggtggggacacagctaaaccatatcaatggttttacctacaattccgatctccctaaaatgtgtaaaaccaaatggtaacccaactcccttcagcatatttctcagtacttcttaagaatgttccctgggccatggtcactaatattggctcagaataaacctctttaaagtattttacaaagtttatttcttccattaacaatgctaagtttaaatttatatatgtgtaaatgtattaaaaattatttaaatgtaatattgtaacattatgaaagtaggttatgagagttgagatttgcaagatagtattaaaaaatattctgacactaaaacactaaggaagaccttattcaaagcaattgcgagagggctgtgcgtggtggctcacgcccatattcccagcagtttgggaggccaagattgtggatcatttgaggtcgggagtttgagaccagcctggccaacatggtgaaaccccatctctactagaaatacaaaaactagctgggtgtgttgactcacacctgtagtctcagctattccagaggctgaggcagcaggatcacttgaacctgggaggtggaggttgcagtgagtcgagatcccaccactgtactccagcctccagcctgggcaacagagtgaaactttgtttgaaaaacaaaaacaaacaaaacctcccccaaaaaacccataccaaaccaaacgaaagaactattgcaatatagagaagagacttaactccaactacagcaaacactgctagaggtacttagagccaatgagcagaataatgcagtcaatgcatggaaaactactaacaggaggtatccagggcagggggagtcttgctaaactggtataagagttatagaggaaagaaacacgaaacacggctggcagttaaagacaggttttctttagttgaaacctgagaggtgctcctggctagtttgtcaggagccctttctcttacagactgtgagtatatatttgttttagggtgagaaggcttaccagaagcttggaatgtttatgtgtgtggataattttatggtgggctggaatgtctctgggaggagaggagattatcttggggcagacatctcttcagccaggaggagggttgtctcggggctagcatcttcctggctggaaggggttatctaggggctagcatgtctgtggtcggggaggagtttggaatgtttctggttggagatgttatttgtggtttatggtcatgctgaccttagccattaggctgatacactttggatttaggtggcttttattaggttgaactttagaatgaggggcatgtccaagatggcaatgctcctgctctgtcaactggattaacacaatttttgctaaaggcaagccatagacttaaatttcaagggtaggggtagaggaatttgatcaagtgtcaaaggcaggaggattctcactaaactgacccagcaggattcttgttaaaggcaggccaaggtcaagggctagttgtgaagtagatggaggagcctgaacaaattttagtcaaggcagatatcttcatcaggagtgctaaatgcatttctaaataacgtcacaacagcaatcaataaataaataagtacatatatatatatgatcgatgtggtcaaaaacttagaggaaacaaaaatatttgctgtgatcattctactggatggggctgtagtacatactctaaaagctgtgaatgactgaatggtggctcaccaaaaattccaccaaaataacctattaaagataaagcatggctgacttaattgcttagtttggtaaaaaagatcactcttgtcacagaaagtgagcagcatatggaaagagaaaagcaaagaagagttgcttataaagttttgggggtatgtagtttgacaggtatttcaataagtggtcttgattagagttgggcatactttgtgattaagagtttaggataggtgaattgagggatgtgagtgctttggagaagctcttaaataggaaacagtcatttgtttgtgctgtatgttgttctgagaaagatatatttatgagccttagatgggcggtctatttttcaagtaaatgggtttttggaaagttcttgaaaaaaaagaaggttatttgcaacttcagcttcctggaaagaatttcctgaaatattaaagtcatatcaatgcagacagttgaatagcaaattgtgttaatgtaaacagtaagatgtgttggtatagatcgtttcaattctcaaaggaacaagaaataggttccttcttgagtttataaagtaattgaaaacccaaaacaaacacatcaaaatggaataaaaaaactcaataaaaaagatcgaaaggaattacatgattaaatattaactggcacaggagttcagaagagagggatattaggtgaatactttaaaggtgttgggaatttaacaatgctttgaaaaaagtgaaaagtttggacaagatctggtgtatttattagtgggcattgtaagaaaatctgagtgggagtgaagttttacatatgtggagaactgtaagccacagataatctggactattttataggctatcggtagataataaatatataaatatatgttaaattttatattttattattaggaagccacaggtctttgaggagtgtttgagataatggtaagtattgtgttgaattgattgggctgtgtaatggtaatacctagagccatagaaaactcttacaaaactagcagtagtctgggtgagtggtcataaagaacaatataaatataggagatgaagatacaggaaaggtgtaaccaacaggatggtatgtatgtaaatggaattttgagggagagtagagccaaaactataaaaagtttaattgtagtactgagttttatatgtctacaagatatgtgatctagcatagaattagaaatatagaactggcctatgggaaatgtcaggacattagttgaatgtttaagaatccatataagaaggtgtgagtagtaaaatagtcactgaagagctgttggaaaaaaaaaaaagcctacagctgagtttggaaggatgcctttgtttagatagcaattgagaggaaagagcatatagaaaaatttgaagaacaaataccagggcaagatagtggttcaaagtcaagagaagaggattgcaaaaccctactgttcatcatcattgttacacactatgaagttgagttaggtggatattaaacatgggggaagaacatattgtatttggttattgcaggtcagtgatgatgctggaagtctgaaatttcagtagagcaaggactgcagctgtactgcagaagatacagagaatagcttgtatggctgttatggagaacaaggtggaaacccctcaggcaaaaggtttattgaggcttactgtgaaagggaaaaaactaggaacagagaaaaacaccagacttaatgtactttttatttatttatttattttttgagacagagtctcactctgttgccaggctggggtacagtggtgcaacattggctcaatgcaacctccgcctcccaggttcaagcgattctcctgcctcagcctcctgagtagctgggactacaggtgtgcaccaccacggctaatttttttatgtttagtagagacggggtttcaccatgttggtcaggctggtctcattctgttgaccttgtggtccacccacctcgacctcccaaaatgctggattacaagcatgagccaccgtgcatgtactttttttctttaatccttttgttttttgaagcagaaataaaagatatttaagagcttagagcgcattgacttgtttataaaacagagcttctctttgcgaaggagaaagttcatctcttcccaaaagtcttgggaaaaaaatgtgcatgcaatgagatcttgaagtagaaataaaggatattgaagccatttctaatggcctcagtttcttcagttaaatatatggatcctggggctcttcaaaatatgaggaaagtttaacattgttgtgagcagtgttttagggagttgaattaggagcctactgtgttttaattgtgagtagctaaatattctagatttaccattgatatatttaattaaagaataaaatcttgttgtttaacaaacccttcctagatttatttgagcatttcctgtgatagtcatttcattttttccacattttatttttaattgctcagctttttttattgagtatagtttcttttaaaacatggaatgctacagaatttcaattgtggatatatcaaaaatagttttaaatgaagattatgtttggattaaagtttctcagagaactgatttgccagagttttttctactttttgaaaactctttctctatgtagagatagattatatatttattgatttaattttaaaacactgaaactagattatcacgtcaaaattaaatgcatacttaaattagccgttagcaagaccaacagaaaccaatatggtgactttttattgttacatatggaagatgaattttgtcggatttcaacttctcagaagactcacagcataacccgttaagcaaagctgagtttattacctataatagtcagaaaagacaacattttacaagagtcggagtgtccagaaggagaggattaaggcgaaatatgaatagggttggaaatctaggtttgagtagataagactgaactttcaatgtgaggatctggtttggttaggcacatttcaagacgtaatagtttaggattggtgaacacagaaaggcaggaatcttgaagtgagttgtttgataattgagccatttacccagttttaggagtttaatgtttctagaaactaattttcagccattttctgaaaaaaaaaaaaaaaaaaaagtttttcgttctgatttacaacgttaagttcataaacaagaacttcctagaacaaacagtaaaataatgtgaatgtaggctgcctttatttttggtcctgatagataaggtggatgcagaagtctcagttcttaatttcaataccacattgagaactaaattaacaatggaaaatgctttattatctgctttgtgtggaagaggtataaaatataaggctgcatttacctgaaagattttaaattaggatactatgtttttctttttgtcagccaaattatgggaaaaaaaattggatcgaaatggcagtaatgatagttagggttactgcagactgaaaatacgtgcttagatctcagggtacacaggccagatagtgattctattctgccatacattttcattttaggaaaactgactgagtcgaatgtgtgttcagaataattggctcttaactgtcaaagagttaaaaaggagaaaagattatttaatcaaagtaccttgtagatatgcatagtgccatgctttaagaatatttcaagtactcctaccttaatctttccatgttaatgcacttaagtcattgatctgattcactcatatttgattacttaaagttaaacaaaatatatcatacaacatttagaaatgtagttccagaatgaaggatcactattagtctggtagataactgttaatctagtaacaggagtttcaaaactggggattccactagtgattataaatcaaactgtaaagtaggataaatatgaaatccagaagaccagattataaagaacaaaaaaaaccccaagaaaattaataagggcagatattagtttcttttaaaataattcatgcaaaaatctttattatttattaagctagagaattacatgtgaattttaaaagtttatcctattaatgcaacattgagagtctaacagtaaaatttgcaggagtgtagatctaaaggtatttacaaatctcaattctctgtagatttttctcaaggccaaataattatccaagaaaattgactttaaataaactgatattaagtgtagtctttatcttttcaaacaagcttcacttccttctactttgttctaagggaaatcatgatgaattttctttcgatcacccctaataacaacctatcactcatttaagattttctttcactatgaggaactatggggtcacgcatttctttttctcttctcttgactaggaatcaccattcatactaaaattgctctatggcttttctttctctctaacaccacagacctcatctcaatttaaaattctgcattgtgcttgtgtactcacccaatgatttcttcctatccactgcaaaaaccagttcactgagacgttggtattgcagtaaagaagagtttcagtaacatgagattagccatgtgggagaactggagttattactcaatgagtttccctgaagtcttggaggtcagggtttttcaaggaaagtttggtgggcatgggactagggaatggatgctgctgattggttgggggggatgcaattataaaagtgtggaaaactgtgcactgagtctgcctctggatgggaggtcacaggactggttgagtcatgagtccaggtgaggccagtctgaaaatcatctcagaagaccaacctgaggttctacaacagtactatcatctatattatctatatataggcgagtcacaaatcttgtgacctctggccacatgacttttgagcagtaagggattatagaaactatagctacattttaggagaattcaggcctctttcataatttcagttttgtgtcctttcattagtattacaagggtggtttcaacccctgaacgaggaggggatgaggtttagggagggactattattattcttgtttcaaggttaaactataaactaaatttcaccaatggttcgcttggccaatacccaagaatgagtgaagacagccagcctacgagcctaaaagcaagatggagtcagccatgttagatttctttcattatcataatctttgcaaagatgtttttgcctgccttttgagagaaaagctacttgtcgagtgttttgttttgttttgctctatttatctccatgatgcaatggaaaatggaaatttattttctcttaatttattgagaaaatattgtaaggatgattttgttagggcatgctatttggctcttgataattcatgatgatatgttcatcacaatcaagaagtgggccagagatgagaatattttaaaaaattcatagagggaatagaagttagaactcaaagttgaggttggactgttgatttgagcaagcattaattgtgagcaggaggacaggagatcaaatcagctggcaagaccaaatgagcattacagatgattggtgttgctgttgagacatgatcataaatatgaatgaaaaggaaaaggaagagaggaaaagaatataaatcaaaataaatatttattgtttatgtaaatctgttatttgttctgcatcaacagaaaggaaaacagataaagttaatgataaaaaaaaaagaacccaattcctttttagctgataaaagaagttcagaaggtgatacaggccttaatttaaagatcatatagaactatcagtccatacggccagcctcagggagtaactgggaaatcccttctttatctccttactttcctccttcctaaaaagtccatttgactttccctgtttcccaggccacagttccaacatgtcactgttcccatgtgattaaggtcaagaactactggccctctgtgttattcttgactctaacaggagagtcatattggactatgtgttttgaattagatactgaagaaaacaaacttcagctttgctaatatttcttgcttcttgtcatataaattgtacgtgtaactattaataatatttaaataatgagagaaggggtcagaaaatcttgttctgccaaaagtgtcagacaccttttcgtgtgtttttgtggctaatctttgtaactcatcatttagtacttgttttataactttgcaagtggagacattcagtttctgagagattgtaacttatacacattcattcactataagtagtgaatctaatctccattaatatcacctttcttcctagaatgagcaggagattagggatgtgtaagcaagaaaaggctagaattgggtaaaattgggtaaaaagattatgatttaaaaagagaacatattcaaacctactttaatgtggctatcttctcttttacctaatcatatatatatatataattatgtataattatatatatatatatatttatctccagagtatccttatatcctgtcagttttacctcgttagtaatttcaggcagagatattgttaagatgttttaattttctaacaaatatggccaaacttacctcaaaaatatgtaaaagcaattatctgaaagaaatgcaattatttaaaatgaagacatagttcttctagagttgaaaaagttcattcattgatatagtagtagcctcagattttgagctgcaattgtgcaagccaggtaaaataccacagaaaaaattcacaacccagaagagaattcaagatgctgaataggaattcagtggtggtagaagaattggatccataaataggtctgcatgagaatgattcaatcttaggagacatagaactgttagagttacagtcaactggcagcacttttaagttaaaatactggatcatcatcagtaatggtttactttagagactggaggcacttctctttgcccattttttctcaccacagaatgtgcagcagactgcccatattttaattaattttcatttgttaaaccatgaacctgagtggccctcatactaaccccttgttcattgcacaatagaccatgtgttaggcgggcttcctgatctttcacgagaatgaatgccaagtacagaaatctgcttgggttattgaaggctaaaaatgattattctaatgtgtctgtttattttgcacgttttctcccctacagttactatattatctagtcaatgtatttgtcaattgtgaatgtctttgttgttgcagatacagatgtggtgtataaaagcgagaatggacatgtcattaaactgaatatagaaacaaatgctaccacattattattggaaaacacaacttttgtaagtaatgaataattaattactttatgcatttcagtactgtttagaaagctctctagatgtacataactttctattcttcagctccagcatttgtaaagcatttcaggtgaaaagttggggctggaatatcataagaatcagtaaatctattgataaaaaataccctgtgactatctgcttcattttcttcccgtttactcttgttaataattggagaaatatttccaaaaatagtagttgcttagaaagaataattttcccaatattttatatataacattagtcatacaaataccaaggttaaaaacaatggctcatctagccttatttattattaactttcttttcttctttacttttcattctttctgacttctttctagttctgttgttttctggatcagatagaaaggctttctaaaggtggtcttcagctgaggttgatgtgttttagaatttaggattctgtcagtaccattttacttattttgtatcactgtttcgccaacatggtttaaattattgtttgtatttatattggtcttaatacagactttgtctttctgaaaaatctagtaccctaaggttaggagacttagctataattacctatttggtaagcaataatgaatcagtattgcaaatgttgaaaatctagctacccaacaccaacgaaaaatagtacacagttatttacttactattttattgtaattaaagtttcaatagactgccaattagatgaatgtatacaatacagacaaaatatagtacaagctctcagaaaacctccacaaaataaaaaaataagcaaaattgttggctacttttaaaaatgtattctacttgtacatttaaaataaacgtttaatcttcgtatttattatggaatggccctatggaaaaaatggactaagaatattctgtttagtatttttacatattaaggagaaaaggtcattacaatcattaagtgattatatatgtatatcattgggctaaatttaaccagccaactaatgtacattaataataaggtcatcagccagaagaaaaataatgacatttttggttttaaactaattacagggaatcaaagaatagttactttgtgtgcaactctttatggtactcgtgggatgtcaaggatatgtacagcagattgcctactgtctaagaatgtggatttcctttgggagataatactaacccttacggagaattttaataaacagtatacagcagtgtttactatttcttcagtggatggtcctcagggatactagaaaaaagcctagagaatcattgagaaatactgtcaatagtggaaaattagccattagtaagaagataggataggagacagaattccagaattgataatgatgagaaggtatgatgataatatatggattaaagtcagaatgaatggatttttaataaaattagtttggggaacaaaaattgagtgcattttaatttttgctttttcttcataaagtaacataattttatggagattctaggccctcagtagccaagcattcaggttagatatactcagtacatgaattattctattatgtggctgtgcctcattaaatactcatttacacaagtcagtgaggttttcccccatcactaattatgttttggttttccattatttattcattacttttttatcttccatgatacatcaaaaaagaaaccaaaacaaacagaacttttagattattattccattatctcaattcttttgctggtactacacaccatcaccatctcatatcattgtggttttctccatgtgctaattattgctgttttatctttgtgtttctgtgttatatctttttaaatccttttgaggtctctttctattctcctctacattagccgtgactcttaattaccacagggtcatatttagcaaatattctaatttacttgtcttctaagattcatatgctccctaaggacatttatgtcacaacacagataattaagcaatttataagtcctagaggtgtctaaattcgatgtcgggcaggggttaggggagtggaaggtggcatcagtttgcaaccagttacccaaaactgagaacaaaaataggaattaccataattccagatgatttcaaaggagcttgtttaatcattctctcctaacttcaaaatggcattatttaatacacttatgtttttaatactaacgttaggctaaaaccgggatttaatttctcttccaggaaactctgttgaaaaatatattttattgaaacatattgctggtttttctgtgagcaattatcaatatcttaattataataataattaattggatcagatcagtataaaaagctttgaaatgaaagcatgacaagtcatttgagaaaataaatatactattgatgaaaatgtcataacagaatggcctgttctatagtaagacatattatgctaaaatatgactacaaatttatttttaaaattaagataatttgacatcttaatttatcttatgatatcttgtttgacatcttatcacttttcagcttaaacacattttaaatatgattggtgtgtacttttggttatgtaatcatggttagcagactctatgattaaaataaatattgggcatggttgccaaaataaaaaatacttttttaaaaatgaaataattgtgttaaggcattcttttggattgaaggtaggtggatttctaatgaaaggaggaaattaaagggcatacaacttttgaattagaggatgggaagtaagtggtttagcctcaaaaatgctctttataatttctaagtgtttggaaatgttatctcttaaagccagaactatttcaaacaaaagctcagtcacaatgtcataatgaggaaactgtttcctaagtattagctgtactctttctgctgtcaataatctgaatatcaccagtgaccacggctgaaaataccggcagctataaattgttttatcaaatcactttttgaaattataagggggttgtaaacataagtccaagccccatgtgcttaagtatagttaagattttaaaaatatgtatcttttttgttttttaagacacaagctcttgctctcttgcccaggctgggatgcagtggtgcaatcatagctcactgcagtctttaaactcctgggctcaagtgaaccttctgcctcagcctcctgagtagctaggaccacaggtgtgtgccaccaggctcggctaattttttaaaacagtttttttttttttagaaatggagtctcactatgttgcccaggttcatcttgaactatatcctcaagtgatcctcctctggtggcctcacaaagcactaggtttataagagtgagtcacagagcttggccccctagaatatatatcttatgcattaatatgaaaaggaataattgagagataagactctaatctgaaatctctgaaactctgtaagcctatttaaatacattctactaaaaaagtagccataacacaggaaggaaattcatatatggcagcagaatgattccaagcaaaatgttagttacgtattcattggtctaagtgtttatttatatataggcaattacaaaatagtaggtttgggaagaaccaaggaagattcattgatttataatgcctagagacagcatcagctggcttcgatgtcatcctagtgtttttcatttggtttctttgttgttttatttgttgtgctgttgggtatatggaggtgatagatccaactctgtaccgctgtgaaatcaagaaacttactattcagtttgtgtttgagtaaataggtgccctattgaaacaacaacaaaaacaaacacagtagcacagataaagaattactgaacaaaggcaccgacaattgtacctcataaaatttgagatgaggaaagattatcagaaaattcgattggccacgtagcctcacataatggccaatagtaatggatgatttgttaattatttgtaagatttggtctactcagtatctgttggaatcccagtagtgatagacatcagtagtgtaactaacactgattaatcagtgaagctgtgcatatcaatgttgtgttttgacagtattgtttctttctttctctagagcagtgtttctccactgggggtgattttgctcccaggagacatttgtcagctctggagacatttttgattgtcctgaatgaatgtgaggggtttgctgtgggaatctagtgagtagaggtcagaaatgtgcatcctacacttaacgcaaccagaaatgtcaggagtgtagagtttgagaaaccctgttctagacagagatacaagagaaaccctgtgataattagaaggtaattttctgaggtgggatcaaagtaatgacttttaaattgataattttaagggagatattaaactgtggcttccaggttcattagtttcaggtacttttcttcttttgaataaccctgcaaagaagaccagcatgcatgagtaggatcatttggccttggcttcctctcttgtgtgtattgctgagtataaaataaaagtgtgacccagttttcttacaatttttggatgatacttctgattgggacttttttgttcagataagttagtatcacttatttggctattgccaactttttttttttttttttttactaggaagcagttgttcctttttaagatagaggataaaaactgatggctactggggactccagtcagcataattgctttcattggtgcattgtgcttatgaataattgaatttcatcatcttttgcttgggcatgtccttcccctcgctatagcagttaccatttcctgttgctagataccttcatatttatcttatttttatcattcactatgaaaatatttagatacttattatatccacaatatttatttaaaaatgattatttatgtttgtttacattatttaggtaatatttggaatatttccaattcagtcatcaaaataggatgtaacattgatgtacattcagggaaacaaatggaataatacatgtttcagcaaagattggacacctttctatatttagttagggaaggaaacattgaatctaccatagacatttaggctcttcaaaattttctgtaagttagatatatgtgaaagtgaattccagcatagctttaaaagtagtggtcattaaaacagggaaattagaaagaaaatttctgatccttaccctggaagtctactcaggcactattttaattaaaagtgtgagaggaaatagtcttgttgcttctatgtgtttgcaagtgtgacaggattaccctgcagtttcaaacagttattcatacagttccccataggtttaaagggctaaaattgactactacattattattttttaccctcaattaccattatgaaggatctagaaattagattctactaactaatttattcatgaggacaaagtatctcagatggtaggaccattttattgtcaataatcatagtgttactaataaatccacattcatagccatttattatgcatattgttaaatgagtaagtcatccttataaacaaagttatctaagtaatatataaataaaattatctgagtaatataaaaataatattaaaaataatataactaaattgtttccttcagataggaatacaattatgacaaaaattaattagatgacacttgtttaattatatgaactagagcttggttcaatcttgtctgacagagcctattagatatatgtgataaaaggattacaattccagtgttgatttttttagaagattcttatttagtctctttggagctggaggtgtcagacaggatgctggaaaccaacaggcagctagatttataacaactgtttgcgattgttttggaatttggcttcctgagaggtcagctctctgacgtgtatccagaatcagtcagtccatcttgagcaagtcgaggctctagtttaaacatttgatggatatttctgcccttcattttcttgctgaataattttatatattgctgtctcccagtcatagaaagccaattagaaatttttaaaaatactggccaaaggatacaaagtgtcagacagaaggaataataagctttagagaaacacaacagggcaaccagagttaagaataatgtattgtgtatttcaaaattactgagagtaaatttcaaatgtcttactacaaaaagatgggtatgggagctgatgaatatgttaattagcttgctttaatcattccacattgtgtattcttccatatatatcagaacatcacattttaccccataaatatatacaattatagtttataaactaaaattattaatacaaataaaataataaaacactcagtgttttattactttatgatggaacttaagcaaacaaaatacattttcgagaaacttttcaagctttggaagttgatgatataaaaataatttttcccttcttttgatctttcagaatacttcagtctacacagctttgatgatgtagaactatgcgttgccaaaacttctgcagcccttccacacttcacattacataatacagatattttaatagtatattggaaatatattaaattagtattttagtttgcttgtgaaacatgcgtgagcattcaaggaagttcaatttttggtaaacattaaatgataatgacagctcattatagagctagaaagcattttccctgtctcctacttcagttgaaatttaaaaaagtaaaaaatcaactgagacccagagaaataaagagacttgctcaataaatctagtgtagtcttgagactaaggaaaacatttcttgactcctaatccattgttgtttttaatattactagctgagaattccattcaaaataccttttaaagaaatgtgaaaataaataatgatcctttagttttttatatatataaaaatctatgtttatttgtggaatttttacttaaaccttttaggaaagatgcttgaattaaatatatgtatgtttgtatgtatttattcatatgttcacataatacagatagaatagatatctatgtatagatctatctatgcagatattgatctatctatatctatcaatcaatcaaccagtctatccattttactaccagataatcagtaaggaaacattatatagtgagtggaaaagaggaaaactgtgagtgtggtttacatagctttgtttgccttaacttgtctgaagtcatcatatttgtttttaacatattttaaatattgtgatgactataacctgtgtcatcattctttccatccaaatgttttcaattattgttgaaatattgcctcgtgaacaaaggataacaaccttggctgcattacacacacacgcacgcgcacacacacacacacacacacagacacacacaccccaccaagcaagcagcacctattattatgaactactactctacttctcttctttcccctgatatatctggctgaaataatctagtttatatttgaatttcttctgtgtcttaaaaacttgtagagatttttctacttctccatctttatgatgtttctgcatcattgttgaaatgactcattatgccttattactttattaatttatttgccaagtgttgtttggatccctgttgtgtgtcagataatattccagattctggggatacaatggagagcaagacaagtttgtcagactgacaataaatgagtaattcattgaaaatacaagaaaatgtcagctagtaaatttaaatccttgttgaaaaataacatagggtgaggtctagagaatgattagttgcttaggaaaggctcactacggagataacatttcaaggtcaaattgaagagttgtgtaggttgcaaggccagtaattacaaacaacatagggttcaaactatatagatctattccaagaacagaaaatatgtaagtggtggacatgggtagagaatggtacaagatgaactcaatgagataactaggggaaagatttatactgagttttgtaggtcaaggttttattttgtgagcagtaggtacactctgaagaaagaaagtggcaatacctaagtcatattttaaaagtacactctgtcaattatatggagagcattttctagggatattaaagtagaaactgagagaccattctgaaggctattgcagtggtacaagtaggagaagatgcagggtgtgaactatgtacagggatgctattggagaaggtaaaaagtaggtgggtggaggatttgcttggagataaaatgggtagggctttgttggttaattaccttcaacttgttggaaatagaggaatcagcatcatctctgaggttttaaatgtcattaaatgggtaattctattttgaatattttgccacaatttttgacaatggaatctatttcatggttaggtcttatatgtacatgtttatgcatgttttctgtgtataacagtataacagaggaatttttagaagcctggttgaaaaaatcttgaaataaaattaacaaatttataataaatagaacatagacatgcaatccattgtctcttggggcttaaaatatattatattgcctatgattatttgattcaatgactccataatattttatatgctttttctgtcccaactacaactacagctgaagatacaatagaaaataggagagaaaataggagagctcctgccataaggaaaacaggagagctcctgccgtaaggatctcattatgtattaagggagatatgcactaatcaaataattagatatataaacatttacaatttatgacatagaataactgcaaagtataggaatataagaatgaaagttaaatattgcttttacttttattgcttaatatccatgtcagaatttctaatgcattggctgtatctgttttaaataagtcacggaaagctttcctaaagaaatgaagatgagccgggctcaatggctcacgcctgtaatcccagcactttgggagcctgaggcaggtggatcacaaggtcaagagattaagaccatcctggccaacatggcgaaaccccatctctactaaaaatacaaaaattagctgagtgtggtggcatgtgcttctagtcccagctactcaggaggctgaggcaggagaattgcttgaacttgggaggcggaggttgcagtgagctgagatagcgccactgcactacagcctggcaacagagcgagacttcatctctaagtaaataaataaataagaaatgaagatgactgcagataagttgactaagcaagaatatggcttgagcatagtgggacaggcatgaggcatggagtattagaaacaaagaatgccatggtagtgggagcagcacaaggaagggggaaacaggttggagaattaagtagtggccagatcatgcgggtcatggtgctaaattttcaaaaatgatcagatttgcttttggaaacaaatatattcccgttgaagtgagaaagtaagttaaaattgaaagttgtggctcaagaaaggacaaataaagacactagtggatggcctaggcttgagattataagcaaatggacttaggcagtgccagcagagaagagaaagatttggacgataataataagtaaaataaaaagaaagtaacaaaataagaatgtagtggttggtgatggcggttagaatgatgtatcagggataattcttgagattttggttgtatgacttaaatgaaaggggagttaaccattgagatggggaattctgggtgagaaccaggtttgagcgtatggttggatgaaaatatctgttaaacggcatttagtaactaagtggggaaatctatcaaacagtatttagggtgtcacatttcttgattcaaatgtgaaaaatgaacctttaagttaaaaatagtctccactcctaggtggaggttacagtgagctgagattgcgccactgcactccagcctggacgacagagcaagactctgtctcaaaaacaaaataaaacaaaagaacacaaaacaaaacaaaacaaaacaaaggtagtctccacttcttaaaaagaaggagcagagttgtggatcatatggtaattctgtattagcagtttgaggaacttctaaggtggttgcatggatttgccttcctagcaatggtataagaggggcttgattaattcacatctctacaaaacaggttcttacctatttgattttagccattttagtgggtgtgaagtaatatcttgccatggcatttatttgtattcccttaatttattgatgatattgaggatcttttcttgtgcttattgatcatttgtatatctttgttggagaaatgtctgttcaaattctttgcccattttttattgagctcttttcaattgctgaattgtaagattttttcatatattataaatcaaattccttgtcagatacataagtttcaaatgttttctcccaggtatgttgtctttcactttctgattggtgtcttttgatgcaccagatttaaatgttgataaagtcaaatctattttttctttagttttctatacattgttaatttagactaacttctttttgtgtgtttgagaacataatagatttttatttctatgtttagttctatgatacattttgagtggattttttaatatgatgtgaggaaagaggtccacatttattcttttgcatgtggaaatacaattatccatgtaacatttttgaaaagatttttttttctgttgaataattttggcacccttctcaaatgtcagctgaccacaaatatatgattttgtcttgggactctgtattctattaatctatatgtttatccttaggccagaagttcagtcttgactgttgtagctatgtggtgagacttgtaatcaagatgtgtgagcccttgaactttgctctttttcaaaattggatttctgtgtcccttacatttccatatgaattttaagatcaactcgtaaaatttgcaaacaaagtcaaaagaagctaagacttttgatggtgattatattgcttatgtagatcaatttgaaaaatagtgctacactaacaaggttctgatctgtagacatacaatgtcttttaatttatttagatattattcagtttcttaaaagaatgtgttatatttttccatctaaaaatcatacttttattgttgaatttgttactaggtattttattgcttttgtggccattataaatagaattgtttactccatttcatctttaaattgtttgcagctagtgtatagaaatgtaatgatttttgtgtgttgaatgcttatcctgccacattgctgtatttgtttagtagtccaggctctttatactcataaggggttatcagtctgtagctttttccaactatgtctttgtctggttttgatatcaagataatactagcctaatagaataagtagcaaattgtttcttccttttattttttggaaaagtttatgaaggattttttttaatgtttcatggaactcactgatgataccattatggcctaggcttctttttcacaggaagttttaaatttatttcatcaatccttttacatgttataagcctattccaaatatatattacttctgaaatttatgtctttctaagacttcttgttttgatctaaataactgaatttgttgataagcaattttatagtattctgttacatgttcatttctgtaaggttgatactgatgcctcttctttcatgcctgattttagtaatttgaatcttgttattttttctcatccatctatctagaggcttgccaattttatttttcttttcaaggaagaaactctcagccttattcattttctccattgtttttttagcctagatgtaacttatttccacctaagcttttttatttccttccttctgcttgcttgtgttagtttccttgtttttttcctgacttctttaggtagaagtttaagctattaatttgagatatgtattttcttcttgcccttttttcttctttcttcttcttcttcttcttcttcttcttcttttttttttttttgacacagggtctcactctgttacctagtctggagtgtagtggtacaatcatatctcactgcagcctcaacctcccaggctcaagtgatcctcccacctcagcctcctgagtatctgcactacagatgtgtgccaccattcccagctaatttttttaaaaaaagttttgtcacactgtggtctcactatgtttcctaggctgatcttgaccttctgggctcaagtgatcctcctgtcttggtctgccaaagtgttgggattacaggtgtgagccaccacacaagacttcctccctcccttccccactccctcccctctttccttccttcctgtctccctccctttcttttcttctcttctatttttctttctttttgacaaagtctcactctgttgcccaggctggagtgcagtgttgtgatcatggctcactgtagccccaatctcccaggcttaagcaaccttcccacctgagcctcctgagaagctgggacttcaggcatgagccaccatgtctagctaaatttttaattttttgttagattgtgtcatactattttgcccaggctggttgtgaacaacttaccccaagcaatcctcccacctaggcctcccaaagggaggattacagacatgagccaccgcacatggcctaagattacagatatgagccactgcacctggcctctggctttttctttctttcttcctttcttttcttttcttctttctttttttcctctttactttctcactctatttcgttcctaatatagatttttacagctaataatttccctgtaagttcttctttactatatatcataaatttttgtattttgtgttttcattttcattcttctcaaagcattttattatttctgttgttatttatttcttgattcattggttatttaggtaactgttgtttagtatctatatatttgtgaatttcccaaattgccttccattattgatttttaatataatttcatttgggtcaaataacatactttttataatttcaatacttttccattcattgaaacatgttttgtggcctaacatatgatctcacctagaaaatatttcatgcaaacctcataagtatgtgtgtattttctgctagcatttctgtctgtaagatctttttgctttagaatgttgtttgtcttctattttattactgatgttctgcctactggttctatccattgctgaaatcaaggttttgaagtctccaactatttattattaaattgtttattttccctttcaattctataaatttttgcttcatatatttgtgagctctattattatgtgcatacatatttataattgttttatttttctgatagaatggcccttttattattgcataatttttatctttgtctctagtaagaatttttgccttagagtgtatttcatttgatgttagtgaaaccattctatccttgttttgtttaccagtttcatggtatacctttttcacctttttattttaaacttattagtgtcttcaatttagaatatatcctttgtatacagcatataattattttaaaaaaatttatcctgtcaacctacacattttgattcatgtgtttattttcatttaatgcaattattaataaggtagaacatatattggccatttatttaataatatttgttttctacatatcatatgtcatttttgtttctccattcttggatttctcactccttttttgttagatattttctgctgtatcttttatatttgctattgttcctttttactattttttgtgttatttatttagccattgccttgtaatttacaactagcatcttaatttagaaaaaatttgttcagataaaatactaatttaatttcaatggcatacaaacattattccaacttcatttcatgtttttcacccctttgtactgtaattttcatacaagttatatctttatatgttataacccaatcaacacgcttttataataattgtttttatgcagctatgttctaaaacaagtaggataagaaaggagttacaagcaaatgtgtttatgttttctttcataataactgtgtggatacttttactaggtcattttgtgtcttcatgtggtttcaagtgactatttattgtcatttcatttcagcctgaaggacttcttcctttagtgtttccttagagcggggctaaaagtaacaaatgctctcaggttttgtttatttagaaatgacaacttctccttcctttatgagagaaagtttagctcgatatagaattctttgttgacaagctttttcttttaatactttgaagacgtcaacctaaatctcttctgacctctgtggtttcttatgaaaagtcagctgttattataattgagggttccttgtatgtgatgttatgtttttagtgctgttttcattaatttctctttgtctaagttttgtcaacttgactatgatctatctatgtgtggatctttttgagcagaatttttttgagtagaaacttggaattttttgaacttcttaagtatatatattatgttttatcaaatcgagaaggttggagtcattattttttaaaacttgtttctacatatttctccttttcttctctatagtctttatggttttccttctttttaaatattggatatgtctcactctatacattatttatatgtgtctcttaaaatagtaactttaaattataattttaataaaacatggtctaataatctaaatattactctcagggttttccagtgacattttttaaaacaagataatgaaaacatatattgtaaaatataaatatttacactatctgatatgaagttcattagatacatgtggctacttaatttttaattaattaaaatcatgtaaaatttaaaattccatctttcagtcacactatccacattacaagttttcaatagctaaatgaaaccaacagctactacattgtacatcgtagagataaaacattttcatcatcacagaaatttctgttagatagaactgttgcagatgtatatatcataaaaaattcccccttcataactcagtacccatttttgaatgaagccatgtaaatatttgtatctgtcaaaaatcttctacagaaatatgtttgtatatatcttcatggatctatacataaacaatataatattctataatatatacatttatatgtgtgtgtatgtgtatatgtaagtgtatacgtctacattatatttaatttcaacagtacatatggtctatactttttatccacttaatgtatcttgaagagctttttatatgaacttttttaaaacaaaaaaaattgtgtaatagcaccataaagtgttcttgtatgatgtattaccactggtttaaatatttttctattacattactgctccaaaacaaacataaacaaacagcaaagcaggcatatttcaaatatatatgtaggctaaatatattccagtgtattggtgagtcaaagaaagtttatattgcaatttattagataatatcaaatttcattaatcaaacccaccaatagtgtatgatactctctgttagtccactcttcctgttgttgggtattgttcaaccttttagttattttcaatttggctgataaaagatagaatttaatccttatgttgatttacaatgatttaattatgagagaggttgagaatcatctttttatatgtgcattggccattgttgttttctggtgtttgaattcctgtgcataagtctttcatattgggactttgcaaatgacactcatggcaggaacattttaaaaaaatatttgtacttagtcttaatctaactggaattattcattcattaatatctgtaaagtccactgaaaggatgttctgtgtttcacatatcttaataaacctttatctgttgaaactggcctgaaagaagaaatgaatgaatgtaaaggaagagagaacaatgggaacagttgtgagtaaatgtctataattaactcattcagttataaacacctgtttaataaaattggaggaatcatctaccctataagagttggaaatattacccttaaattttccttcagtttttaaaatgaaataaaatgaataatgaaaaaataaacacacacactgaacaccttcttccagccttaggattaattcagcctctatttggacattgaaaaacatgcataaaactgatttatcttagcattctacacacttcacaaaaaaattgaagctattggtgaacatttctgagaaagtggacaatacaagaaaaggcttttggatttgggccataaaaatgcaagtttagtgcatgacaactcaactagtgaatgtctgcctcagctcctaagcacagttgaggagatcagcagtgtttgcagatgttcttgggagacagtaaaatagaacccggttcttacttcagagcttgagattttgctcaagacattgaatctggaggcagctcttgattgtttcttattgtcattgtcactaaattggacttgattttataggccttctttctttccccaactaagcagaaagtgccaccagggatgtaaatctaaaattattcttttcctttatttttgttatttgctttggcatggaagggtcatttatgatatctctgcttatcaaaaggatactgacaaataaacaggaaacagcaaatcaatctattattaggagtcccgaacaggaggtataatgttacatcggttaatatattcaagaaatattgatattctaagctgaaaacctgagccttgttattctttgttttttttttttttttccaagtgaattgcacattcagaatcttcttaatggtcagatccttatattttttgttgcttgcatcctgtatctgttataatttcatgttaaaattagaggatggagatattttagcataccaatatgctaagttgtaaattatgaagacataatgaaaactcttagttaacttagagaatgttaatgtaattaatatgtaaaaactcttccaaatcaattgaaaatgaacaaaaaatataaatggactttttatcaaaaaatattgttgataaatttaaaagctgcttaacataattcacaaacaggaatatttatcaacaagaagatagtatttttcacatatcctattggcaaagattaaccctgatgttaccatgtattggaaagactgtggaataatagagcctcttactccttgatagcaggaatgtcatttgtgtttttactttgggtaaaattttgtcattattgtgtgaagtataactttcacatgccctgtaatctaaaaattccttcctaggtatataccataaggaagcaattgcacgtgtatttcaggaaacaggaacagggaggtttattcagtcatagttgcaaacaaccactggtctcctcaactgtgcttaggagctattaatggatatttctgataaaatgacctgtagaatgcatggctttcaaccttggagaattaaagtgcaagtttagtaaatgaaaacccaacttttaaattaattcactatgtaaattatttatatccttgggtttctggttaatgtctaactcagtttgctttgatacatatatatatgtttgcctatatgatgtataatttaatcttagttggtcttgaacttttgaaagaggcatcaggtagtccatgatcatcttatacttccctttatcactcagcattttgttactgattcatgcatatttgcatttaacctgtagtccagttattttataactacaagatattctatttatgtcattctcttggttatatgatatgccattctttacatatattaccatatatttattgtttatcttacatttaaatttaattgggaattaaatttgtaattgctaaatctatcacgattgacaatacgtgaagagacaaaagctgcaattaatccaattcaagagagaaaatgataaggatagagtagatatctgtcttatctattaattcatatttgtcttatctgctaaatagatatctgtcttatctactagttcattttgtattgctgtaaaggaatatctgaggctgggtaatttacgtaaaagatgtttatttggctagtgattctgtagactgtgcgaaaagcatggccctggcatctgcttctggtgagggcttcaagttgctttattcatagtggaaggtaaagggcagcctgcatgtgcagagataacatggtgagaaaggaagcaagaaaaagagagaggacgtgccaggctctttttaacaaccagctctcatgagaactaatagagtaagaactcagtatgataaaaatggcaccaagccattcatgaggaagcctgtcccatgacctaaacacctatcattagagccccacctccaacactggggatcaaatttcgatatgaggtttgaaggagtcaaacatcgaaactgtagcaatatcaaatatggtatcactgaggaatatatatgaatatatcaaatctggcacaattaaatatcttttttatttgttaacctatgttttctcctattttttggaattattaattataatgctaaattaatgatgttatataaacctaaaatgagcctttgaaccatcagctgtcaagaagatttagtctttgaagcactactatttttctgtttctatttcataaaaagaaaattcagccatggtaaaaaaagtttttttacttaatattggacattatagtttcccttctttttgtaaatatgggaattgcaaagcttttggtaaccattatttttcttacactagaaataaaatcatattactaattgaaatacttaaaatatgcgtgttttaaaataataattatattatttttgtttatgaaattatactctgtaaaatgtgcctgatgggctatcagaacaagaatgaaattaagtaactttctactgggcagctccggtctactcatcttgtaagtattatgttacacacattgtataaggccatggtgaggaaaactcataccgaaattctaatgtcaaattttttaggacttccatagcttttatatgctgtattctttaatgcagctgtgcttgaaggtcacagcaccatttaaaaatatatatatacttgatataggatgattataaagcactaagacaatttgaagaatcattagaccagcacaaactgaacttcacataaataatttgcataaatatggaagttacaatatttcttttcttctttcatcagcccataacttttccaatttattaaagtgttgggtagagaaatattggcatgactctcaaattcaccttttctgccctatttttttaagttattaatagatttcagtgatcattaatttccactttctgcgaaaaataaaaattgctttttaaatgttttagtgtatggcctatgatgtaaatgaatagaatattattttggctgtttacatttattgagcaataaaaatatatgtgtgtcagtctatatggattagtaggtattgattcaatactcataaaaattacgtagttgtatcatggcattttctgcattgggttgttttattaaatactccaatatcaaaatgcatggtaacaagaaaatatatatatagagagagcatctattatgtttacaaaatatagatattgcagatgtcaggaaagagatataatttaagcatgatcataattaattagtcagctaagaaaagagaacatgaaaaaatacacagtaaaaaaaattgattttaaaattttctgcatatatagccagctatagctacagagaacaatcaagcctttgtttacagctaaattataaaagctatttgcttcttttctgttcttaaatccagacagtgaaagagagtgtgtcttttgcatcattctagggactgctgcctcctttcccagcttctcttgatttcccttttcttcttttcaactagatcgtaatctttttccctcttctcctccacttatggtccactggctttctaaaatccttcctcatgctcaaaccagggaatttggtcatttatggactgcactatgaaagaagcattttcataatatatacttaattacatgtttcaaaattaacatctttccaaaatgatagatggcttttctaaatatttttgtcaggtatcaaaaaactaataatgagattgagtagtgagggaagttataccctaaataaattaaacataaaggatggccgggcgtcatggctcacgcctgcaatcccagcactttgggaggccaaggcaggtggatcatgaggtcaggagtttgagaccagtctggccaacatagtgaaaccccgtctctactaaaaatacaaaaaattagccgggcgtggtggcgggcacctgtagtcccagctactcgggaggctgaggcaggagaactgcatgaacctgggaggcacaggttgcagtgagccaagatagcgccattgcactccagcccgggtgacagtgcgagactccatcaaaaaacaaaacaaaacaaaacataaaggatatgtgtgtgaatatttagggagtttgatgggctggaggttgagggagcagggaaaatatcataggatccaagaagacttacatttttgtctccatcattcactatctgttaaaaatgtacccatctatactttcagaattattcagccaaagctcctggagcatgatttttttttttaattttgtaaatagagatgtctttagatatttttattaccagcttattccaaggtctagaacaatacacatccctactacacagttcctaaggttctgccgtttctcaatgttaaggcaaccaagtcctttataccaacttgtattaattgtaactgcatctctcattctgccttcactcagtcttttctcagtctcaagtcatgcaaatgaatattttatgttttctgacacttctgacatttaagtttgtgtttaatgatttcttgctatgatctttaatatctgacatcttggaataccatcattatctcattttctacctctagttataatgtttctgacaaaagtgaatcattgtaatggggcctcttaatagggacattaccgtggcaataaaagatgtaaattgcagttccaaacaacctagaagtgcaatcacgaaacagtgatcaatggttagatgaactgcacgtgtaattaaatacatgtgaggtcagatgaatcacttgagctaagaaggacagggaaggcttaaaggagaagaattagaatgatccttcagagaaacacaatttgagtaaggaaaagggaaaggtgaaggtggtatagcaagtagagaaagttgaacaaaggtacaagaaaaagaaaacatgcacatttaaagaatacaagcaatggtacaccatgttcataactgcatgattactggcccacccggtagagcatgtcatttggggaacttgttccttttctttagagggcatggatttacgtggaacataaactttcatctattactctgtataaatgataaaagatgaggctttctggcatctctcttaaactccaggctttttatccacaaatcctgcacatttcctattggctatccttcaggagcgataacaataatgtatataaaattcgaatgtctaaaactttcctcaaaatatgcctgtttttctttattttctccagtgagaatgttacaaaagcaacattcacccaatgataaaaacttgaaaacctggagttattctgtatactttcttctttctccatcttcaaatctaatccttatttttttttttttgtattttattcacaatctcccctgtacatgtccctttcactctttgcctctgcttcttccttaactttgtaacattgctttcttggattgtcatgagcctcttaccatctctcatgaactcgagatgtcatcaaatctaactagtttttcacccagttgccaaggtaatagttctaaattcaaacctgattttgcttctttcttggctttcagttttaccacttatgaaaacagtaataagcactggcatattcatgttgacaataatgcatacttcatacataatagcagtaatctatggaatcatccctcatcttcccaagaattgtttttaagctacttgtgcattttttgaagtttattctcatattgtaggttgtaattcaaaactggcaagcttgtaggctccagacagaatctggcccccaagtatatttaggattgaatcataattttaaaattatgaaattataagttaaattttgctttctaacttttttgaaaaaaatggaaaactagcaatactgtgtatttttctataggacattgtatctggagctgaggagctactgtgctcttttaaataggcggtctgattactccgcctctctgtgattcttacacagacagcttcagtcttaccctgcttacccagtggtttcaagcaaccatgttttggacccttgctctaccagtgactaacgaggttcatgacatgcatcttatcctgaacaatatggaaagggaaacatcctagtgggtttggtttcccaactttgtagcaccttcagtgtctgcctgggggcttgttgtacagtgaatgttcaacacataagattcgcttgaatggaatgatacgtacaaaacaggcaccaccaaatgttcccaagctgccggaaaacatacatttgtttctctacttgatcacataccttgtctttcttgcttaattcatctagttaatcacctgcatatttgctttactctgtttatcatatcttgcttgccttcaacagaatgtacatagatggcaggattcatgcatttttatgccctttgtactattttggatgtcgaaaactggacaggcaggcatcattgctgagtaatggcaatgaacacatgtggaaattacttttgcatcctttcatttcaatagtaattaagttgttaaatatgaaggtactgtaatagcattattggcaataatcaacttccccaaaccacaatttgaagtcatattaagttgaaattaaaccagaactatttaatgtctacaattagaatcagtgttgaccaagatgtctcctgtggctgaaagaaagaataccccaaatgcaataaataataacattaaaggcatacactaagagggattgacctaagatttccaacatcttctggcgtgttgactaagctgccgagatacgtttcttattcgtgtatcatcagtaagtttctctgcagcatcagtgacctgcccacgactctttaatttcagagaagattcagcagcttgggccccggaaaagatatttggaaaatttcccagtttgtgtgctgcataagcttgaggcagtagagggataattaataaagtgccagactgggtaattgtaggaactgtaaaagatactaagacgttgttaccggaggcacagacgcacctgtgaaagcgtgaagttaatttgtgtgaggaacatcacatgagggtggatgaggatgagggaggtgagatttccttcaaattaattcagactttagtcagagaagctctcaaaaaaaaaaaaaaaaaaaaaaaaaaccctcctgctagtgagataatgtaaggcttatgaaaagaggccctcctggattgtcttgttacgtatgcttctctctgaccttgagaaaggtgtaacaactgcaacgttggaattttctaatccctgtaggacaagaatgatgacattgccctatcagtctttacataacagcgtaccatttcatactgtccccttgaacatttccttaaaaacaatacacctcctgatactataatgttggatactttgtgtatccagtgtcaccccaaattccccataggttaatttctatcaaatttcaatatacaataaagtaatgagagagagaattaggtcgtatcatagtattgccctgaagactgtttaaaatcattgataactgcaaagttcctaacaacttgcagaccacatggtagatgactgatcagtggtagctgctaatgttgttattttcatggttatttaaatggatcttttaaaaactaaaaaacaaaattcttgacatgaattgttgccagtgaatgttgttatcttcttctaaaatgccttatatgtagattgtacaagataggtgtaaacccccataccttagcattgccatatggtgatgtctcgctgaccattccattctcttgcatatctggctcaggaattaataacctatgtcattccaaaaatgattctctgataccaattgagtgctctacaattcaattcaatacggagactaattaccaggaattagcgtacacccacagttaaggagctcaattcccctggtctgtcctcacctcagatgccagctgccagtccctggtcccaatggtactgaattatgtccaacctggctacaaatgtgagggttctcattaccccttttcaggctggagaatttcttagaatgactcaaagagctcggacaagagctattcttatgagtagcagtttattgtagagggtacaaatgaacagctagatgaagagatatatggggtgatgtctgaaggggtccccagcacaggaggctctttctctttggactggggtacatcaccctcccaatgcatccatatgtttaccaaccagatggttccctcaacccttatcattcagagtttctaagcaaggtttcatcacttaggcatgatttattcaatcactggccagttgctgaactctgatctccagctcttctctcctaccagatcttagagtggggctgaaatttctaaacttgtaatcgcatgattgatgtgatctgatgaccagcttaatcctgaaactataagctaacgcctcccctcacaaagagtcctctgatgttgcagtcgcattagcatgaaatcgaataaagtgcaaagaagtttgctatgaataacaaaagacatttctatcatttaggaaatttcaagggtttttggagctctgtgccaagaaccagagaaaagaccaaatatatattttattataccacccaaacttgccaaatattgattagtctgaatttcttatcctatccattgtgttttggggtccctatgtaaaacaaacaaacaaacaaacaaaaacaaaacaaagaaactctgactttacacttttctggactttatagagagcagtcttatggaaactataaggtgtgcacaattgtttatgcacgtatttctctgcaaataccatgcaaagtatctattatgcttaaaattttatactatttattttgtgtttttttgtttctattttggagttttttcacacatcaactcaatgtgcttgccctctctttagacgtgaattagacaaatatctctatttcaagtgaaatcttttttctaccttgaatgtatttgtttcattgtgtagtttaaattccttctgtcctcaaatttgttcaattattagattataggctcaaaattagtcaagtacagtgtagtagtttttgtttgacatcaaatgcaatgttctgtatttgtgttttaatctgtttcaccctggggatttcctttaaagagagtctgtctttaatgttagtatctttttaaatataaacattcaaccagtaagaatacaaaaacacagagacagaaaattatgacaaacagaatgtcaatacttcttttccttttgattaatctagcatgcaaattataaaagcattttggttactcaggaatttcaataggcctttgaactttttaaataataaaaatattaacatattctttaagagataacatatagaaagatatattagcaaacctgttcttactgaaatgtctaatatgtcctctttaagctttttatattcatctgaataatcatacatacatacatgcaaatatgtatacaatataaaagaaatgagaatgccattttatagtgctatgaaaattgatttttttttacatttatacatccaaattcatgttaagaagtttttaaatataactggtttttttttctttttctaggtaaccttcaaagcatcaagacattcagtttcaccagatttaaaatatgtccttctggcatatgatgtcaaacaggtaaaggagtgatcttctttgagaatacttttctttgtgatgcattggggtgacaatgcataattttactcagctataactcacctaagcaaaatctggcatgtctagtaactaccggaggacagtaatgactactttgcacaaaagatgtttgaagataatgtccaaacatcttccatatctgcacagcaaataattgggacagtttgcccagtgcctgtgctgatccaagtccatctcttggcagaggagaatgtggcagagtttagcaaatccaacaaatgcgggcttgtgaaagtttcaagataagccttaccatatacttgagtgtttcatgtgtgtacagattagagactttcctagtggctgtgcctagagcttcagatgtgtatattgggaaggcaactgctgaaaacattgattatggtcaagggattctttactggtatttgattgtcagcttggggttgtagaaaattttgcaaatggggcaagccaagcaattaattctgaacaaataaaatgttctaattgaaattagtgtttccttattccatgtgagccctaaagcacaattagagcaatatgtatggttgttgagtgttttgtacttaggtatcatttgcacgattaaaaagcaaagtaaatgttggaaagccaattcagcagattagtatctgtaaagaataaatgattggaaatcattcaaggacgtttatgagctttaagacgaacaataaaaatttatgaacttaaggcaggaagcctcatataatgctttgaaagccttttgaacacatggaatttcacagttcgaaagaactgctatttgatggctttagtcttttggaatatacatgtgctatatttttaaggttatattttttgacttaagtaatttatgctgtaaaagacagagggattttagtcaaaggcctcttttcctagtatagatgttggcctgttgtcttatcttttgctttgagttatctttattcattgggattttgtaagtcatatgttatagtaagaaaaatacttgacatttatagactaaaatattatgctaaaaagtttctaacataacattatctgaaaaatctaagcttgaaaagtctgctatattaaactgatcatgaacttttaaaaaatcaggtttcaggagctattgtaatgaagactggaactggcagtaggacaaacacatagatcaatgaaagagaagagagaacccagaaatagaccctcacaactatgcctaatagattgttggcaaaggtgcacaagcaatttaatggaggacagtcttttcaacaactagtgccagaacaatcagatatccataggcaaaaaataaaaacaaaaagcccacaaaaaacaaaaacatcatattggcttaagccacacaccttatacaaactcagaatggatcatgcttttaaatgtaaagtataaatctataaaacttttagaaaaaaatgtttgggatttaaggctagggaaaaatttcttaaactgtataccaaaagcacagtccaaaggaggataaactattgttccatgatagaccctgttttcaggctaaaaatacaagttacagtctagaagaaaatatttgaaattcccatgtgtgacaaaggatcaacattcatatataaagaattcttaaaaatgaacggttaaaaacaacaactataacaaaaacacaactatacaatcagaaagtgggcccagacatgaagagacatttcactgaagatttacagatggcaataagtacatgaaaatattttaacattactagccaataggtaaatgcaaattgaaactacaatagaatatcactacgaatctatcagaatggttaattttttttaagtgaccacacccaatgatggcaagcatgcagagaaactggatcattcatacattgcagttggaatgtataatggtacagctactttggaagatattttgatagttttttaaaaaactaagcatatatttgggttggttccaagtctttgctattgtgagttatgccacaataaacatatgtgtgcatgtgtctttatagcagcattatttgtattcctttgggtatatacccagtaatgggatggctgggtcaaatgatatttctagttctggatccctgaggaattgccacactgtcttccacaatggttgaactagtttacagtccaacaatgatagactggattaagaaaatgttgtggggtgggggagtggggagggatagcattaggagatatacctaatgcaaatgacgagttaatgggtacagcacaccaacatggcacatatatacatatgtaacaaacctgcacattgtgcacatgtaccctagaacttaaagtataataaaaataaataaataaataaataaataaaaaccaaaaaaaagaaatctaattataccacataaataaaccaacatttatttaaacattaaaaaaaaaactaagcatatactaccatccgacccagcaattaaatttcactggacaattccttcaagtcatttatcccggatacataaaagtattcacacaaaaacctgtatgcaaatatttgcagcagccttatttataatagccaaaaactgagacagcccagatgttcttcaaaggatgaatggctagataaactgtggtccattcatcccatgtaataaatattcagcaatacaaaggaacaagctttcaatgtagacagaaacatggataaatcttcggaattatgccaagtgaaaaaaaaacagtcccaaatatgattgtttgtatgatttcatctatataacattctcaaaatggcaaaattaaagaaatgaagaagagattagtagtttccaggagaaaaggagggaaatgagagcagctttttttgttttatgggacaacaagagggatctttgtggagatagaaatgctctgtatcttaattatataaatgtcaatgtccttgttgttttcttgacctggttgtttacttgaccaggatttcttatagttttataagatagtatcggtggggaaaactgggtgaagaacacctgtgatctctcagtattatttattataatggcatgtaaaaataattatgtcaaaataaaagattttaacttgaaaaagctgtaattttttaaaaagtcctaaaataaggcaaattttttttttttccggtgggagggaggccgagagtttcactcttgttgcccaggctgtagtacaatgcacgatctctgctcactgcaacctccacctcccaggttcaagtgattctcttgcctcagcctcctgagtagctgggattacaggcatgcaccaccacgcccagctagttttgtgtttttagtagagataaagtttcaccatgttggtcaggctggatttgaactcctgacctcaggggatccacccgcttcagccttgcaagtgtgagccaacatgcctggtggcaaaagtttttttttttttttttaattcagtttcaatttattttattaagtgtatggattatgcaagatcattgaaatcttttaccccgaacaaggtactggaaagaggtaaaaagatttaagtatgcatttccacatttatagttttatgcaaatctgatacagtttttaaagattagtgaatgaaaatagttaaaagtagtaaaaaatgatcaattattaaataaactagtgaaattagtttgagaacttttgtattcttgtccaagtcagttgatttctatctagaagaacaatttttactatttgttttcagggaagctggttaactgtctatgaaaagtaaaactgttttaggttatgccagatcatccctgatagtgtcacaataaccattctctaaacacagaaactgaaactgctttttcatcttatttttaaatagtaactttgtgtaatttaggtttatgtttttaaaatgtggaataaggaacataaaactaggttaactttgagtatttggacaaaatagggcacaaacttttaaaaatataattaacaatataaacataattatggaccagtcttcatattcttatggtcttttttttcttatcaaggaacaataaagatactttatgacaaaataactggaggtgaaagaatgctagcatttaaataaattttagaaactttatttcaccattttatatcatttcatttatttattcattttatttattaattatgtcccaggtgcaattgctgggctgtatattatagggtgtatttgtgggtatgctcacataaattgaattacctccttcaagaaatttataaccaggaagaggtgatatgacacaaacatttatatccacagcatacaacatcatgttatgtatcatatatatggtagtttcaaagaataaggaaaacttttactcagggtaatcatgttagagaagaatcatatgctgggctttgaagagcagacagctaaaaatgaatagaaaaacaggagtttgagaccagcctggccaacatggtgaaatgccatctccacaaaaaatacaaaaaatttagttgggtgtggtggcacacacctgcagtcccagctactttggaggctgaggaggagaatcacttgaacccaggaggcagagattttagtgagctgagattgactactgcactccagcctgagtgacagggcaagactctgtctcaaaaaaaaaaattaaataaagaaatagataaataaataaataaggcaagcagtcattctcactcttggctatggcattagaatcatctggagagttttacaaattgtttatgctgaggccctctcctgcagaaactctgatttaattggcctgaggtatagccccagctttggagttttacaaactccccaggagataatgtgcagctagggttgaagaccattgaatttaagtgaactgatctcttccacccattgaagactttccagatttcagaaaagggaaacattagaaataaaaataaaaacagctaattatttaaactgcatgtattttgtgccaaagtctttacttgtacacgcttaatccttatatcttttattcttaacacacaacagtagttggtgttattcttcctttattggtgaaaatacagagactaacttacctaatatgattcaagattgagtttttttttttttttcctgaaacagtgggtctcaatgtacatgctcagcatagcagcatcagcatagcctgggaagttattaaaaatccaaattctgttgtcccattgagacagaaactctaggagtgggcccagcaatctgtggtttgacaagcgtaagtgattctgatgcattcaagactgagaaccagtgtttagggacctgattccttaaactgcaagagcgctacctaagaagagagctacgcagccagaatctcaccatatgcaggacaaagattaatagaaaatatcatttaagagcaatgatctaccctgtttttctttagtttttcacaattatttcttcctggatttaacgtccaactgttcatttctgaccttggatgttgctctagtaacaaatttacccttcaaggttaatgtttgatctgttttcattataggtggcatagtggggtgtgcatggaagttggaagaaaatatgtgtttaaattcaaattatccatattaaaatttgtattgaaatataacatacctataggagcttgcatatactatgaagatagcttgaacttctataaaccaaacacctgtatggtgccatcacccagataaagcagcaaaacattgctgttctccattctgttactacgagccacaagggagaacactgtctacatttgtaaagattaattctgcctgtttttgcactttaggtaaattcacacactatgtactgttttgtgtatctcttattttactcaataattagttcataaaatatatccgtagttttcaagtattgtataacagattgtacattcccactatgatataccattccattgcacatatcacaattgatccactctactgttgattagattgtaatacagatgtacatgagcaatgcattattgtatagattatttgtctgatcactctctatttcccatccattactctgcttcttctttgacacctatttcaaaaaaatattatttaagagggcacaaacattttttgggtgcttagatagtgcatctgccgtggaagtgtgtttatcaatgtaaacctcccaaagtcccgcttcttggctgtttatatcatattttacagaggagacagacttagagatattaactaacttcctcaagggccccagttcacagttgcagagctgggagtgaattttttttcttagctccaaagtccctagcttttcgattactttgtcattttcagaaagttcttatttatctttacagattaactgtgtattttcctatttatttgaaatcatatcaactaattcctaattaattaattggaaggcaagtgaaacatactacaatatgtatttaataaacatattacaatatcaaacaatatatgattttcaatactcagtacttaatatacttctccagacatagtggttagacattttatttttgtatttgcatctttacaactgtttctcaaaatagtcaatgaaataatcattctggaatgccttttaatgccataaaattaaaaccatacttttaaagaagatgaaagcattccaaagtatggcaaatcatgatatgttaaaaccttgatgatcagaatatttgtggttaatatttgtcatctagtattttgatagtcaacatatcagactaaattattttttcagcattctgagtcatgtatataaatagttttaatttaaccaataaatctatgtaattttatatattatccatatatatttggaattattggtccattggaattatttaacaattgtatttttaagccatccttaaaaagtcaagagtcctttaccgcatttttttaaggacaaacatgaagtaaggagaaatcaatttttttaaaatttttaaacaaatttatagttttatagttttcttgtttggatttaaaatacaccatgtcaagtagactagttaactattttacactgtcaaccactttcttaatacatcttatgtttgttatcagaaactttaattaaatttactcttgtttcagcagaattagagctgtcctctatacataatgggacataaatctgcataagaattagctttttccgaatgcaagagtaacagttgaatgaatcctttaaatcgtgtctactagagggaacaaatcaaccgtagctgggctacatctgctatgttagtagtatctgtcctctaaattcgatgctctgcaaaagatcagcattgttattttctacagttagatgcattcatttcagtttaggtctctactattttatagctctgggtacagaattatttttctggtaagtatctattttaactaagaagtaatcctgtaaaatgcatcctgcatgcactactgctttaagaagtaactcttctctagtgaattatctaattaaagtctggaccttaatacttcagtgctttacaattacagatacatatttaaaaattctgggggagtacataatctggttatagaattatctaggctgttaaaattcatacattcggggttcactaatatttcaaaaaatacaaactcaaagaaagcacagtctgggaaagttactgtgttcaaacatgtgggactctgagttcatcctgaaatcctcctgccttctagtgcccatagaatactcacctttcctcgtttgtagttgctgctgctgaactgccttcctatgtaaccttctccttactacacagagatattaaggcattaaaaataagttagtatcaattttggaatatttcttttgggttaaggcaaaaattgaaaagtccctaggaggtggacaaaaaggaaggaaagaagtaaacacaagaaatatttttggaagccagtatttacaacattttttggtgaaagttactaatgtatttatcaatttatcactaattaaacaacacacttttatttatttttttattttttatttttttttattattatacttcaagttttagggtacatgtgcacaatgtgcaggttagttacatacgtatacatgtgccatgctggtgtgctgcacccactaactcgtcatctagcattaggtatatctcccaatgctatccctccccactcccggcaccccacaacagtccctagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattttgaataatgccgcaataaacatacgtgtgcatgtgtctttatagcagcatgattcatagtcctttgggtatatacccagtaatgggatggctggatcaaatggtatttctagttctagatccctgaggaatcgccacactgagttccacaatggttgaactagtttacagtcccaccaacagtgtaaaagtgttcctatttctccacatcctctccagcacctgttgtttcctgacttttttaatgattgccattctaactagtgtgagatggtatctcattgtggttttgatttgcatttctctgatggccagtgatggtgagcgttttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttactttaattagatcccatttgtcaattttgccttttgttgccattgcttttggtgttttagacatgaagtcctcgcccatgcctatgtcctgaatggtattgcctaggttttcttctagggtttttatggttttaggtctaacgtttaagtctttaatccatcttgaattgatttttttataaggtgtaaggaagggatccagtttcagctttctacatatggctagccagttttcccagcaccatttattaaatagggaatcctttccccattgcttgtttttctcagatttctcaaagatcagatagttgcagatatgtggcgttatttctgagggctctgttctgttccattgatctatatctctgttttggtaccactaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagcgatttgtagttctccttgaagaggtccttcacctcccttgtaagttggattcctaggtattttattctctttgaagcaattgtgaatgggagttcactcatgatttggttctctgtttgtctgttgttggtgtataagaatgcttgtgatttttgcacattgattttgtatcctgagactttgctgaagttgcttatcagcttaaggagattttgggctgagacaatggggttttctagatatacaacaacatacttttaaatagcatctttttattttgaaataatataactgtattatagagaatctgaaaatacacacacaaaaaaagaagatagaaataatgcctctatccacctccgttttttagagaaaaccactgttaatgtactggtttatctcatctaattcttatttattgttattagtatgtaatattttttccacttatagacaaaattataaaaatagtataacacagtttactatcatgaacattccactatgaacattgttccttgtcttaaatatttctcaaaaacattattttaatggctttaccatcttttcatgtggtgatatcataatttattcaactcaatatctttaatatttatagatagttgacagattagcactctcactattacaaaaatctgtcctgcaacgaacactaataaatatctgtctttgtttattctcagttaaattaatgagactgaaattatgggattatatattttttacattaattagtgttcttgatgcatattgctaaaatgcccactagaaagcaaagtaaatgtatgcttccccagtaaagagaaataatttaaggttccttttggtttatgatgctattttataggacacgaatgctttttctaaggtaaatgaacaaacataaacaacaaaattatttatggataggagaatctgtgatatgttagcaatttctgattccttcttacactgaaagctctgtgattcatattcactctctaagtgcaaatatctaagctcaagtcattgagaaagtaaacctattttaaaaaaaataaacaccttcaatatcaaataattgccttcattactctggtaaaattacactaggattaatagatgagtagaattagcaagcgatggagtaaaagtaagtttctcctcataggagttatttagtgagacttattttaaaactgttactacacaagacagtccttaattgtaaaacataatggagtcatcatttgtatctattcacaggtagtttatttctatagaaataatatcatgttctcattttaaactgcaagatgcaggttccaaccttcttctttagctttgcattcatttacaacatacaggtaaatttgaaacatgtttttagaattggtacctatatatacttgtattaagattatggactcttctttagttcagtgggttcctgcatgtgcctgttatttatttttactatcatgagataagtatctaagacaataaagcaacctatttccttatggtgtgttgactggcaaagaatccccttgcacatggggaggccacaaagtagaaataggcttagcatggagaaaaagtaaagtgagtccctatatatttggcaaatattaggttgaatgtgagttaagcagttttctctattataaggctttagagagattttaataagttagtgtattataatttatcaaatggaagaaaacatagttattgcaccctgactttacttgagacacatcactgtttttttttttttttttctcatggatctgtgtatggtctagaacaaaaaaacatactttgggcagtagtatattaggaaaatactatgatactaagtaaaaagatcttattctggtcacctaataatgacgcacatctgccgaacttcatgtcataaagcagtaatttattgtgatcatagattctgcagatcagggtttctagaagggcttggctgtacatttcccactcgaaggcttaggtgattgatgccagatgtgggggctgcagtcatctgaaggcctggctgagctgggagctatactttcaaagtggctcattcacatggctggcaagttgataccagttgttgactgagaacctcagtttttccatgtgtagctgtccacagggctacttccatgtcgtcatgagagggcttaaggcttcccccagtctaggtaatccaagggagccaggcagagtctgcaacactgtagccttgaaacccataaaccatcactagcactctagtgtgtgtcacacaggcacagctgtgattacaggtgggaaggaagcaatgaggccatgaaattcaagagatgagaatgactgatggctctctcccttgacacagatcctgaaacaaaggaagtaaattgcatgaagacttggaaaatgcctcaggaaatcacgatagagttctgaatactagttaggtgtagtgaggttaggtggctttgaagctggctgaatagccatatccagagaactgtgattaattgatattacatgtgagagcctccatggatcgatcagaaacctatattattatgtattattaatattttcatgtctgtttcttgttctatacactttaatgagtttaaaataaatagataaaagtatacttatcatagttttgaatgagcaaggtagaatagagggttgatttacagataatctatataatcaagattacagataacctaggggtggcaatgctgactggagttcaaatgattaaacttaacagtgtttagagtgaatttaagcatgcattttataaaaatctggctcccaaaatgtagcgtgaaggatagtaatggacacactaacttaagtaacgttattggccacagctcagtataaattcaggctgtcacattaactttaaaaacactgataaatttttaggttggttaataaaattaaactacctagaaccgtgtgccaatactgcagtcaccagccacatgtgtctattgaggacttgaaatgtgagtagtccaaattgaggtaaaaattgtacttcccagattttgaagacttaataaaaaacagaaaaacataatattaattatgtatcatattcatgatatgtttaaataatatttgggatatactgggttaaataaaatatattagtaattgatttaaccagttactctttattttctatgaacatagctactgaaaataagcttacatatgctgggtttgggttacatttctgttgctcagtgctgctcggtggatacaggaggtggatatatcagtgttctaagggcttattggaaaacacctgggatactctagccaattagaggctgtataggagacagtcataattctcaaagatttagcaattgtgatgaaggaattatgtaattgtggaaaaggaaaactctggaaaatatgggaagaataatagatatattcagtattggagggctatcacagagaaaagaagttagatatatttctaagcataaaactagggcccttgatatgaaatggtgccaggaaggcagattttggctccacataatgaagccctctcttaacacttgttttttcactaatagaaggcctagtgttgaagtcagtgagcctttttctctagaaatattcaaaagatgggtagataattgtccatcacaggcattgtgcaaggaaatctaccatgggtgagttatgttgaaatagttaaatttcactgttttccattaatccaagaaggataacagttttacttctgaaatacatcataccataaacacaggaaaaaagagatgtgactttccaactaatatgtcaagtttgaaatgttgcagcttatatggaccttgatttttcttgctacaaatttcaatcaaagcagtagactttgttccatgtaatcgtatcttttttgaaaagtatcaaatatggaataacttttcagagaaccgtaacagtaataattcttagtagaaacagaaaacttcaagttaaaaaaaaaaaccacaaccagatatacacacagagaagaaattcagaagtaatatttgctaatattttctaattataccaagacagcaatgttatgattcctagttggagtttatactaattaattttcaattgttttcacgctgcctattttaaaaaggaaaacagttaaaggttgtgtgttagtaaattaaccagctcaaagagagtgtatagtgtgggggtctctaaatagaaaggaccttagtgtttctgaggaaagaagaaatgtagaatataattagccatgaggtcaacacagttttaaaagaccttggccagaaaatgaccaaggctttatggtcaaaacatttatactttatttttcacagcaaatttttgttaagatataaaatataatctactgtacttgaaatagactgaagtattgcattatgatgcttaattctacttacttaaacttcatgatgtttaattaaaattcacacacatttttcttcccttttcctcttgggatcatttaaggctaaaactggaacttaatctgtgaggtaaatccaacaccaagtacagtgtatgtgcacattatagtcatttgtttgtttctttaataattgaataagtgggggaaacaaagcttgtctatattgggagaaaatatgcattttctgcatcttcctaattccttttcaagagacttgtttcaaaataagagataccttacaggctgaggaaaagctagtggtatttgtgtgaattttgatcttcataaagaaacattaaataatctaagttattcgtgcataattttgcaccttaaactagttttgcacctataattttgcacttaaacttgtgaatactgtcagacaatggttttcatcatattttctttctggataaaaaaattctgtccataatatttcaaatacaaaaacattagcaattttcaatccaaggatatcactttgttattattacttttctcttcataaagaatagaagagcacttttttgcagttgaatttcatttaatatgtatgcctgtatagtaacacattctgagggagagcattttattaataatttacattttctttgtttgcagattgaatgatgccatgagaacaattaatggcatagatgttcatttactctccctcataatttctaagcaaaagcatttttgtatttattgaagggatgcaaaatacaggcatcttgtaaaagatactgtgaaaggggaaattttctaaataatgaatgttgttaatagtcatgatgtttatgtagaatataaatttaaaacctataattaggttattgtggattatacctgtatttattagttattcacttataaaatgaattgtggtatttgttttcagaaaaatgttccaaattatggggcaacatcccatgccccaaaaaatatcctgtttcctgttattggagagttaggttaatttaaaatttcccactattataaacaatgttgcgatgatcatccttgcccttaaaactgtggctgcatttctgataaatcactgtatcaagtgatattaattttgtagaggttattgaggcatattactgcatttcattccaagaagtttcaaacagcacttcctctagctttgtgtttatgtgtgttggggtgtgtgtatctgtgtgtgtgtgcgagagagagagagagatttttaaaatttaaccttttatgcgttattagttttgtggatgagataattgcatagaaagttcagataatttgctaaagatctgctggataataacagagctgggatcagaatcaaaggctcatgatattagccataacgttaacatgatctttttatgttaaaatactaggttaattaatcataaattcattcaataactatccatggaaagcttactatgtaagctttctcctgcactatatgccatggatatagcacagaacaaaacaaatgataatcccttgcataatagtggggagagataaagataaaagaaaataaataagtaaattacgtagcatgttacatggtggtaagtgctagggagacttttattttacattttatttcacttttacttacttttaagtacagactcacacaaatttgcaaatgagtatagagacctttgtattccttacccatcagcaaaatccccccagtggtgacatcttgcatacaaatagtgcattatcaaaaccagacaattgactagcataacataattcatacaattatagatcttaaacctgtttttgcatatgctcattttctgacatgcctttgtgtgtgattctatgacattttttattatacgtaactaccgctaccatcacaactgagatacagaactgctctgtcaccacaacgaaaatctcttttgcttcccctttatactcacatctctggctacttatctaatttctggcaacccgttttccatttctataattttgtcatgttaggaatgatatataaacagaatcatgaagtatataattttttgaaattggcttattttatattgtccaacataatgcccttaagttccatccacattgttttgtgtgccaagattttgttcctttccattgctgagtagtagacagtgacatgtaaagcaaaaaggaagatgccattaaaaagggtgcagttttcaatgcagtggtgagcaaagaggcattccacaggaaatgacacctaagtgtcgacctaaggaagtgaagaaagattcttgtgcatatttgtgggaagagtgtcctaggtaaagggaatatcctgagtaaaattttggagcagccaggaagcccttttggcctgagcagtgagagagagcacaagcattaagagatgacattaaaaaaaaaaagagagagatgacattgagacccattttaaagccctgtagactctacagtttgtggtaactgcagtaactgtataactatggtgattgtattaggtgactcaaatttcccatgacgttacttctaaactctgaagagattgaaagaattatcccttccctacgtgtgtagcaaaatgaatattttataatagaaaaatagtttaattgcaattttatcttttaaaaagatttccattttaaaaaatggaatataaagaactttatattccatttacgaaatgttgtgtcagtgttgtcaaacctttaagtaactttggcatgagacgggaagcatatattctattacttttcatcatccatgatttttactttgtgaaaacctcagttgggggatgcaaaaggaatagaatttactggaagaacagagatagcacctcgtatgaatcagaggacattgcatcacagttggggtcctcagcccagcagagaatatcacagcaaacactaaatagacctgccagaaaattccggtcttccggtccatttgggcagttatgtgatctaagtcaagtctcagtctttcactctatcaaagaataaaaagggtataagtcattttgacaggtctcaaaagcatcttagtaaatgaacaaagctcaggacatcaaagttgacgatgttaatcaaagactgaattgaactggtgcttgggggactggcagtcctaatctgattttcacaaacatgccaatatcaataaacttgcaggtaaacacacagccaaataaatagaagtgcattcatttttgctaaatactagatatttgatttctttaattctgtactatgtaattggaagcttacattttggtgttttacatgtatttctaacaccgcatataaactctttaaaggcagacacatgctgggtttttttttgtctccctcacatgcctagaatatagaatcagtatgtcttcagtcactagctgtgaaaaaaattcatttatctgacatcgaaaaacacaagtcattgcttttggttatgtgtgaatgtcgctgttgctgtaaataaattcagacacagtcaatgagcgttaacatttgattgttattccttctgcttataacaaagaactatgagatgaaatctaactgccaagaatcagtaggggaaagtagtcattgtgttaatttcaatgctgcggtgtaaatttcattaatattaaatggatttttatttaacaattgtaacttcaaaggggacaaaaaattaattaccttaacaaattgaaaagtcttcccttccgctgtacaggtaaggaaaataattaaagaaaaaaaaaaacaatcctgaagaaacactgactctcacatgcttattttcttcctgaaaatgtgagatagtaaaaactgaggaataaattaaaatttgcttctaatgttataaaattttgtcacaaaaaccataataaaaatgaaaatttcttatgatatttgtagaatattcaataatccttgagaaagtgtcaatatagtcagctttctggaattacaggtgtatgctgttgttatagttttaatttcttgtttttacatataaacctcctgggctaccttcagcatatgtgtccatgattgacagtaaagagttgctatttctgcaagtcttttcatgccgagatcaattttcccatttagtccatattaattcctaagtattcacatcttacaaaattaagtgagagagtgtaatctcaattgaggccatgggaaatatgagcaacctggtcaaggttttaaacctgtcatcatggattattttgtatttgtccctgagttcattctggcccaaaatctaactgcccatcctacaactacttagttaagcctttcctcccatcaagagtataactctggttataggctttaagtctggcttattttaagggtcaaagctaaatcaggccacttgaatttagactggtgtcactcgctgttcttaagggcaacataacatatggcattcaagcatatcctcctgaaaagactgaactttacctacagaggggtataaactgttcctcactgctgctggtggtggtgaattgatttcaaatgtagggttgcttatagttggaggatgtttccttttgctttattttggttcgtattttctgtttgttaaatacagaaaagaggctgtttatcctcagaaagtttttcttgactgctgcctaagttgttttctttcttctgggttaaagaaggttttctgggatagttaccgagaaatgacagtgatttttatgtcagaggggatggtagaatacctcgatttattactgaggcccaaaaaagtcaagtgacaaaaaaatctaggcagcggcagagtctgacctagatgatatgtttccaaatgctcaataaaagactgttgtttaaaatactccatgtcaatggcaaaaggaaaaattttattctctccaaaaaagttggtaaaagacagacatatatcttgatctctttcaaatactaattaccttgcatttctttcacatatctactcattcatttttaaattattaaatatgaggaaatgcggtaggtaatagacataaaaatagttacatgtaattcctgcctttcatttgaagagttcacagtgtagttgggaaaatttgtataaatagaagaattacagaacattagagcaaggagcaaagaaaagctccaaaattccaagaagaaggcatcaaaactgttatgaagattgggtcggagttttccaatatttttttctttttaagtgggaagatgccttcaggcatgtacagaacagagccatgaaaggtcatagtgtgtttgcacaacagtgagagacttggtgtggtaggagagttgggaaataaagtctggaaatcagaagtttaattcatgtatttgctaattattttcaatccctgaagttagctgtgatgaaattaaatcacaaatccccaaatcctcaagggctcataaatcctcaaatcctcactggctcacaaagactatatgggatttttacatcaggaaagagctgcctatttgttggttgagaatgctgtttttatatggcacctccagtcctaatgagtttcacaagatcacaggaagctacagagtctcttgtgcaccctctgacctaggacttgcagtaaaagtagatgtcatggtcccccctttatttaatgttttcatccttgatgctcagggcttttccaacgcattcttgaccttgctagttccgtttctatttgagaatggacaaaaaaggcaagaggaagctctgagcaacgcctagatttaggaatgactgaccctcttagacttaaggtctaaatctgcattcggatttgggaacatctttttggttttccacatctacaagacaatgacactgatgagttccattctctccctttccaattggccactaaaacatctatcaaaggtagaacagccactacctacttgatcagcttccagccagatgaaatgtcttttgttgacactgaaataactgaattatttatcaagctctgttctaacccaaaattacgtatgtatacgtaagtgtatatacatctacatatatatgtactttttccttatgcatattctgcagttgtatttgccagttgtcctcaatctggagaaatcaaaacctatagctaatcaatgggttcctttacaatgggatagaaaatgtattttctttcttttccattcatttaggtttctctgtattatatctaccaatttttctcaacaattttattcctcatttattttcatgctgataatgataactaagaggattttctactctctttggaatgagttagataatcatggtcctgataaaatataggtgttagggtaggataaaaaggaagacattgataattaaacttatcaaagaccagcaatatcacatgcactcagcttctttctttgcagatagtcaagagcttagggagtgttatttgaggaactaaaggtgtaaattctgggaagactcatcaaagttggatgatatggtggacagcatgaaaatgtcaggtaccttgggaaaacagacattttccctgtttcactattgtgagacaggtctttccagctcctcccattcttgatgcagaattgctgctctatcacatataaaaatgcaatttaattcaaatgctaattattgggtacctactaatagaattaacatccgctgagcctgacaagaaatgatatggaatccttagaagctatgagcctggcctttgaaaagtttataactgatatttttttccttgacttatttttagttgtgcgtattcctctttatccctgacatgaaatgtcacctagtatccatttccatcccagtattgccctacagaaaactctgggctctaagcaagacatgaatgataacttaaaattcccagcgaggtcattcttcatctttcactttgctaaataattgtggaacagtattttaaaagctatctggcaataacatataaagtagctttagaatgatgcttttgcagtcacagcactaaaacctttttttatgaaaacttcaagatttgtgcaaaagtcactttgtaaatgagagtatttaagacttccgtgatacgatggcagcttctattaaaacgaaaacaaaatgctttatctcattttgcaattttaaagtttgtttcatagctccatatcagatacacttttcttaaaatggcttataggccaggcacagtggctcacgcctgtaatcccagcactttgggacactaaggcaggtgaactcttgggctcaggtgttcaacacctgcctgggcaacatggtgaaaccccgcctctacaaaagaattagctgggcattgtggtatgttcctgtagtcccagctactggggtggctgaagtgggtggatcacctgagcctggaggtccaggctacaataaactgtgattacgccactgaactccagcctaggcaacagagtgagatcctatctccaaaaaaaaaaaaaaaaagacataaataatttcattaaggcaaatgacagaagagcttgcatattttctatttctttacatgtaagatgagcacttatctaacagtcttaagtagagttggcatctttccttaagttagatcaaaatcgattttgtttgtgtttagatattcaaatgcattttgcttaataacccaattagacttgaaaatagtgctagaataagtatgtgattttaacttttgcacaataaaaccttgattagctagaagaaaactaacaagaaatatcaattaaccagaaggaacaaaattataaggcaagctcaaaagaatctagaatttagaaagccgtatagaaaatgtggaagaaattatgtgctgaaggttataagcaaacatctaatctgattcctctgttttttatggttacataatcactgtttagatatttaaatcttctgggatcatttaagcgagttttctcctatgcattagatccttcttaccaaccagaaaagtggaataaaattatgacagtatcatcaacaaagactgaaagaaaagtttctgatgattattcaagtaactcgagtccagcagaacctctaattttcctggcattatgctaaaaatacatgcatggaggaggtgatagtattaaagacgagtttcccaggcagacagtttaggacacagaagtacagacaaggcctcggcacacacaggagtattctacaaatatcagtatagaaagtcagtgatgcaatgaggagcttgtataataggctttagctatattatcaacagatttcaagacccattattacttcaaacaataaagactcagaaaaagatacagttccttgcctccatgaatttaccatctaatgatggatgaggaaggagttcagtaattagacacataaaacagccgttgataaacatcataatgatgtttgatatgtccatgatataaacacatgtgaaatttgagacagctgtatattcatttgaaaatagcattcgcctccatctcaaatacaaatagtcttgcttgattctgtggaaatgtggcagtggcatcatgtgacaaagtttaaatatctgtgtaattatcctcttctctcaccaaaatgtaatgttctcttgattcttctatttctcttaaaggtactactacctatctaacaaagcttgaagccccggttatctttgtagcaccatcaccatcacttacccaattttgttttgatatcaaggaacccagctaatggttccactgcaaatacttaatcaggcctcttagttccctcctttgctatgattccagaagccatgtctctattactgccaggtacattctatgaaataatggctttgttgtttggatacattgacttgctgaaaatcttaaatggtccagtgccttctgttaaataatgtacaaactagttaccctgatatcaaagtctatacggtaggcctggagctgcctttctgacattattttctatatctgtgctgtgtttcctttctaccccaactgtgtgtgatcagtcttctcccagtccaacaccctttgtcctttcttgtgaggttaactgcactcactcacagatgttccttccttgatctccgtccctttctatccaactttttctatccttcaatgtttagtccaaagatcttatcattcatgcattctttccctattctctcatttcaagatgactgtttctgtcactgcactcttttaccactcctttggtttattataaatattggtctgttcattccatttccacaccaccacactagttagaatctctatctttattcaccgggattgctacaatagactcctatttgatctctatagccaatgtatcttacttcctctctagtccattctctgcatagaaaccagaataacttgtttaaaaacacaaaccagtcactggcttaaaatcaatcattgacaccacatttagaataaggtctcaatcccttaaagctctacaatgatatgcaagctctggcttgtctccctctctagttttgtctttatccaccgtccatgctccaggaacatttgatggaatgcatttttgagtgtattttatgccttcttacccaaccttcacacataccattctcccaactgcaatgccctttttcccacatcacacacattcctgagccaagtcactgtgatgatgtgattctgcttctcagaatatacaaatcaactccatctatgcagctcaggtagaattaattccactcaaatcatttgagtcatacaaaaagggggagagacagcttcctaaagggaagtccaaatgctataagaaaatgaaagaataaatgctagtcaggcaagagtgaaaatccactacggtcagtaatggctcttataaaaatacatagttatagaatctttaatatgcatgtgaagtatcatgaattacatagtgaaatatgcatgaaaaatgaagaaaactcatcattgtacatggcatgcgtatcatccaatggctaatgtagctgagttttttttgtcaagttagaaattttcattctcataccaatccctgtaacattgctattgtcattgcatctctgaaacatgttttcagaatgacagctataatgaaatatctgatgcttacaaaatgtgctcaaaaccatgttcatgggaatatgcatagcacattatttaaacagatgaagtctccagtgcacctcacaacccagaaatatccccttcattttctaactactttttcatgcagaaactgaccctcgttcttagtttttgcatgaaatttacagtagccatctgcttaggctgtgacctattttctttctcaacttttctgttaaagagaatcaactataacgcttatttaaaggaatgtgaataagctaaatatggggttgcagctggttcagactctctattgaaattctcatggcctggtataatttaagatctatttatgtaattgctgtgaagtcggagaaacaatcaaagaaagctgtgtgttacatcattttgccaaaagagatattgtgtttgtctccttgtttaaagaactgaactccgtagtagtaatctggcccatccacagatgtgcttaggtttaccctcacaatgttaatgcaaataatgactaaaacattcaaaatataatttattgtcaatatttaaaaattggggaattttatattcaaaatcatattccttttttttctcttgaaaaattggaagatctggcaatattggcatatggagacattttcccatggtaaccattggttcactctcacagatggggcattctctcttcaggtaaccttagcactcacaatttttaatagtttattcttgcagacttcacttgcttgtagtacctgtcaagcttttgtagacatttcagattgtaataattgcttgtcacaatgggatcctctcaaacaaaagatttggccaaaatgaatagtataaggagtacattgtgcaatataattttaaaattaagaacaaattgctcttgtgggcttggctatggctatgatatgggtagcaagaacttcccaagactgggctgtagttaaggctctgggtgtggcagtgaccatgggtcaagctatggctgtggatacagctgtggctatggattctctctccaatgaccatcaaattctcaaagctgttgatcattttgctgctaatttttgactttcaaacttttcatgcctctccctagtattccatgatgaatttcaagatgctcatgttgatttttcttacatttctctttattccttatggacagtgaaagataacatgacattccagtttgatcttctgcctcttgggcagtttccaatattttggtacaatcgacatttaagcatttgctcatatactgtcaaactatgggaatccaatgtatctatttgtatatatattttatttatcatacttcctaatgaaatgtatttacatttatttttaaaaaaggacaaatcactcaagttacaacctacaacaactagaaatcttttcagctacaagtacaagaaaactcaaacacagttggttaaaaaaagctagttattaatttcaaattatatctattaagtaggcagctaatttcatttgttctgtggctctacaatagcagccactgcgtttctaattgcccttaatctttcactgatgcctgtgaccttgctgtaagttggctaccatagttccaggtgtgccacacctattccaagcaaaagagtagattgaattaaacggcaaagggttgcattagttttgtttgcaccctttttatcaatgaaacaaagtatttccatgaagtactacctaggtgactttaattaaagtaaatccctgtccaagaggaatgagattataatgattcatttaaaacaatcataatttatccccttggaataacacagcatttgtcctctctgagattaagttatctcccagagttttcttagcatagaatctgggaaggaggtgaagacatttgtgtaggcaaaggacaaagtctgtcacacaagcgtctatgctcccatttactttcaagcaattttactctgaattttgtcttgtacttcatgaaggctccttccagaataattattgcctcacacggaattattatcaaaccaatcaatatttctgataaatgaggctgctgagctgttcattctgtaggttttattcatctccccttttatcttggattgcagtctaccttggcatgtgataggtattttgaaggaggtggaagatgtttctcagacgaaattattttaggatgtgataaaacaggggcaaatttttaataatttttaaatgtgtttttgttgacataaagagcacaatgcaatatgtattatcaataaatattcatcaatattcatcaataaattaaatatttattaatgaaaaaccttactcagaaacctcaagatcatgatttaggctgggatagcattaaacatgtattaaccagagacataaggcagggaagaccaaatatctcaataatctcttccattgctttaagttattcttcattctttgattttagacaagaaaatattacacaatttatgcaaaagttacactttaaattcctagattttgaggtcttaagtttgaaactaggtttattcagctgtggtgactcaaaagaagataagagagtggaggactcagacaaaaacgtccctgtagttgtcatcgcctagcctgagaaatgattggatttaaaaggaatttactatgctgaaagcaactcagattaatttaatgtgaccatttcaatgtacactcttgcattattcatgtactatctagatattattattttttatgcaagtctacagtcatttgactttcaaagtatatcctgtagatatcctagacctgatacacttggtataaattatggaattacaccataacattaccataaatctttatattcaaatgcagattgtgtctttctccatagctattcttcttgctcatctaaataatatgaagccaatgtaaattagattcataaatgaaaattatcactattttcaggattaagaagtatattaacatatattaataagctgttttcaaatctgtcatttcatacattatagtttttctcaaaaaatgtgaaacttttttatttgaaccttgaatgaataaatataatgatatattaaattagcataaaatattctgattattgagtataatacgttttcatggtcttcctacaagaagaaaaaaggatcctaattagatcaggacattgattaaatgcattagtgagtaaactgaagctagtatttactgaacaaatggcatattatactttatctgcactatgatctttgtagcaaaataatctattgattgttttatatagaccacaccacaaccatgatttggattcatggctgtactgggaagatgcttatatagatgtttcttttggcactcaaaattatgctgagggttttttttttcttaaatgatttccttagataattcttattatactattcaaacaactttcaaaataagtcactgaattatttaaactgaattattcaatgtttcaggtgaagtgaatactggagagggccagattcaggttagcttctaagctccgacacctatctctctctctctctttcacacacacacacacacacacacacacacacacacacacaccaaattaacacctttctccaggcccataatcactgaaaaaccctatcttgctttaataccagtgattactaaagtgtctactcccaaaactactatgtgttctacctagaattttgaccctacattttacaagtttcaggcagttaaaattggtcataattgctgaaattatgtcacatgtgaaaaaatgggatgcaaatcacagatgtgtccttatacctgtttactgtaaggacagcaagcagagacaagagatagagacaagagaatcaagtttctatttttagttccattgtcactgtcccccaccaagacatccatttatcatttctgaggacaccagcagcaatgttattcctgggtttacaagtacatctgaagactaagaatttgttcttgggcaacatcactttgaccacctactgatttggggtagatgcactaaataaatcaaatgcattcattaaatcaaataaatcattaaatatattgattatagtagccccagtctatgctgtgttcacaaatccatgctggtatttcaggagatttacataatctcataccccaaaggtaacaattattaatggttgctcaggaatccttccgaaaacatctttcttcttaagcacacatacaccaacacacataagtcttttaaaaatacaaaaggtctgtatactctgttctgttctgcaggcagtcttaataattttcatgtaatatctttccatgacaaaacacaagtacagggctcttctttttcatcatatcactaaaaatatacatttccttggtttatattgtagtctcttccccttgtgcaacctctgcctgttttactgaacaaatcactcctgacacattgggttgagttatctgctgatgtcctttcccataaatgttcccttctaatacaggggcagctctaaatcttaagctcctgttgagtactgggagaaaatatctaacttctgcattaatatctaggttttcacacctctaaactagaaaggacatgactatagcctgatgtcaggatctcattacttttcttctcttactttggtatctgatgttccaaatggatattgatggggaaatttatttccaatttaagaatcaagagcaaaaattcatcttctagaatatattatttcctattttatatgctctttcctggaaacttagaacatgtgtagaggaggaaaaactttcctctgccctcttacgtttggagctgtggcatgtgaattaaagcatacaaattgtattaatgtttttaattttacatgcattggaaccacacagaaaagaagtgaaaaacctaacggagttattagactcaggggcttatatactactttaacaaaggattatatatttcggaaaatgactaggaaatatatgggaaaactacgatgagaagagttatttagtaaggtttgtttatgcagactcatctctcagtactatctttatttcccgtaacgagggtttttgtcttcctgagatgggagaagggaacatttccacaaggaaaactaatgtgatacttgtagtcagaaagtgggagggcagagagctcttactgtttctgatttctctcaattaccttcagttataaaaaatcattttccaaagtggtatattttggtgtggcatatttggtcccttcatatgattatgttccttttttctatctaaagatggtatcccctaagtacatccttgaccttttttaccttcttatattagcacttgaggaaataccaaaaataataaatcgtataacctattactgatgaaatgtgtatgtttctttttgtcatgtatgtgtggtggaggaggtgcatagaggatatttctctgtaacttctagcttctttattggcaagcaaatagattggcaagcaaatagatttatttctgtgtgtgttttcaagtcattgtgattagcatggactacctttgaaatagccatttgagggtccccagagtctataatttttgaaataggaaaatttcaggatattagtatttttctgagtttaaaagcataacctaaagttaacttgtaggctttttctttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgtatgtggcccaggatgactttgaatgcagcccaacacaaattcataaactttcttaaaacgttgtgagatttttttttggcaggttttttttttttttttttctcatcagctatcgttagtgttagtgtattttatgtgtggcccaaggcaattcttcttccaatgtggccaaggaaagtgaaaatattggacatccctggcctagattgtgagaaaagagatcccattacatttatgaatgggctgtgctgaaaattgacagcaacatcagaatcctaattgtgtgccagcagaaacagtgctattagattttctctgtgcttagcaaaggatttagttagggcattcactttcaagcacccgttctatgcattacacactctcatactgtcttaaccaataactatttctataaggacattctggtgaaattagtgtgtccaataatttaaactaaaatggtgacatctaatattttctcctccaaggtaacgtcagcatttcagagcactttcactatctgaaaacggccaaaaactgatagaagagctttctgtttacaactttatacaccatagtaaagttctaggatgcaaagcttgcacagctttgtaacataagcattttatgccaaattaggtgaggataataagatattgtgacatttgcccaaagtcacggaacagtacaaaactcaagatttgaacaataatttttctgactacaagaatcattccatttctgctggctaaatcaacaatgaaatacaatagttttgcattgcgacttagaggtaccccatgtattccactaaaataatttgtattttgttagaaattaaaatataaccacatgaaatatgtctgtgggtgtctctctctccctctctctctctgtacatactgaatttctaggtgtaataaaatgcggtcagaaagagttcctgcggtaccacattatttttttctttttgcaacatgacactacactacttctaagggctaacaaattttaaaactttcaaaaaacatgatgagaaaattgatgaaagcctaccatatagaagcaagaaggaggtttgaagtgcctttcaaaacagattaccagtctgtcattttgacaccacgtaagatggccgtagaattatccatcatcgagagtttcttcatcaagaaccctaccctccatctgtatagagcttgcaaactaaagcactgccttgttcagagtcttttctattgccttaaccctgtcttcttgtgactgcctttctaaattccacatgaaagtccctttctcaaggtataattttatgtaaacttttgagctgactttaagatttgtgggcatattgtggaaatactcagacatacccagcacatttttccagatgttccaggtgttccagaggtcacagctccatcatggattacaaggcttttggtaaagaaagatggatcaaggttagagagtaaaaaaagaaaggcctactcctatttgtcacttcctgtgaaatgcagaggctcctacctaggaagacatttttcaggtgctgagaggactcttgggattttatttattgtgaaagtttcatttattttgaagtatcattctaaaaacaagattaatgctcaaaatggataatcaacattatctggtacaaaacacatggacttacatgttaaaggtgttgttctttccttatcatctctgggaacttggacaagtcaggtaacgatgtatatattttataagacaatatattgtatacattacatgtacatttgtgtgtgtgtttatgtgtgttctctgagaagcagacccaaaatggtacttgtcctatttcaccctgaaaacaactcccaggagacacatggcctcagcatgaacctggcagtggattcagaggggcagctggatccaccatgcaactattggtcagccgctctccataacaggatctcttgaaggagatctaagtaatgcttttccatgtgccatagtgtatgaaatagaagatctgcacataatttagaactatgagagaaggtagctctgtacattgcaaggactcctgaagatctcattcaatgccgtcattgaacaatggcacgagcagttattaatgaaaaccattggtcagagactttaaaacttcagggtacccaagagtacatttcagcgtttgctaaaatgctattaccaatctcaggaattaggatttaatgaataagtaatgaggatgaattttaacaagcaatcaggggcatcctgaactgggtggtctctataccacagtctgaaaagtactgaccttcctaagcgatgtagaacatacaaaactgtactcattatagtatattctacttaagtggattatgtatgtcaggttttcatactaaaaaaaaattactctggggaattaagagttattttcatttattcagaaaatcatatatagtctatgatattatacaactgaggcatcaacaaataggtaatttttatgaaagttcagaaaggcagtagggacttgtaggcatttggagggcttcattttcccatgtcaattggtatctctctgttacagtaggtgccattatctactttaattgtaatgaatcactgggggaattgtatttgtgaatgacaggtactttcttatgcaaatgaattgcccgcagtgagctagtttagttgatcaagctttccaggtcaagtagggcatttcccagatatgataaataaatatcttgggagctaaagaggaaatcattacagcatatcattctatctgaatttcaaaaagtatttttatatttaatttgttccccaaatactttccagattgactatatatactatttcttgaaatattcactacattactgaacactatcatttttgtgtcattcagcctcacagaaatgttacccaaatgggatgagtgctccagtgaaaatatgaaagccatatgaaaggcaggttcagtataaatgcaaattgctttatcagaaacattgtgaaatcctccaaaaggtactaatttaaagttagtagaacacttttaaagtggcttttaatgtcaatatccctgtaattgtcagtatcctgaaaatagtaattatgacagaattataatttaacaacagtagctttcttagtttgatatatttgagtgacctaattaaagtcattcttaattgttttaccgtttgatttctatgttacaaacttgaatgagagactgctttcttggtgcttagttaatctaggataatattaataatattaaaataatagaatagaacattagacttcagttttgtttctattaataatcaaagttattagtttgtggtttgtatttttgttttcataactgtgtgaatcatacatttattttccaaattatgtgcaacctgattgaggaccccttttaactttacagccaaagtacccagatggcattctgaagtatatcttacaaataacaaggtcaaataaggaggatgcacaggccatttgacagatataatttgttaaaactttatgtttttgtggaaaaccttataggaaataatttctaatgttctaatgtaagcttatgttagatactctgttagacattgtctaccaagcttccatggttttagaatcctgattttactctaactgtgggtacttacatatgaatctacagagaaaagtcctttctcctgtgtgaactagtagggaccaacgactttaaattctctctctaagacttgaggtcgccgttcaaagaactaactgctgtcaaagagcccacagtgtgttcattacttttttaagatacgacaactttgggaggctgaggcgggtggatcacgaggtcaaaagatcgagaccatcctggctaacacggtgaaaccccgtctctactaataatacaaaaaaattagccaggtgtggtggctggtgcctgtagtcccagctactcgggaggctgaggcaggagaatggcgtgaacccgggaggcagagcttgcagtgagccgaggtggtgccactgcactccagcctgggcgacagagcaagactccttctcaaaaaaaaaaaaaaaaaaaaaaaaaaaaaaaaaatatatatatatatatatatatatatatatatatatatatatacgacaagctactgatttaagggcaaggaggagacgggggaagtatatttacaatcttcaaaaattatcttgtggatactgaatacctaaaaagaaaagctcacagtgatctattccccccacccccgacctcccacctaggtagtttggtagtttctgctgagatcagaaattttttttttattctgagacagggtctccttctcttgcccaggctggagtgcagtggcactatcatggctcacaacagccacaacctccagggctcaagctagcaaagtgatactgttagcattcaaaacaaagaacaaattagtaatgggtgttttaatattaaactcatcttactgtggtcattatgaccattaactcttccgtacgaaagtattttgaagtgaatcatcagggactctgagtcagtggtcttgtcttgatgtctcacaacatgggtgcctctatttatttagacatctatcttcaccactcactttcaagtgaaagtgaaagagcaggtcatcaaatttcagtattctgttattttttgcagtcgggagccgtatggaagctagcccattacctaaattgagatgatagaatttgcctattgaaatctcaaggactggccaggtgcagtggctcacgcctgtaatcccagcactttgggaggccaaggcgggtggattgtctgagctcaggagttcgagaccagcctgggcaacacagtgaaaccccgtctctactgaaatacaaaacaaaacaaaaaattagccgggcttggtggcacgcacctgtaatcccagctactcgggaggctgagacaggagaattgcttgaacccaggaggtggaggtggcagtgaactgagatcacaccactgcactccagcctgggtggcagagcaagactccatcacaaaaaaaaaaaaaaaaaaaaaaaaaaggaatctcaaggattgaaagactgacccattgcggtgttatcacgtccaaaaaaagtaggcatattcacatactgttttgagagaattaggaaaattttatgagaaagttatttggaaaacatacaaaattaaatgtatttttccactcattttcaaaatgtactttagcacaagaggcctggtgcatagtatatatgagaagtatttaaatgaagggatacattttgtatgatttttcttacaaattcattaaagtatttcaagtaatatagaataattatttaaccagtgttgcaatggctattaattttccttatggaaggaaaatagacaaagacgtattattgattttcttcttaatctttttaagtttttttaaataaattggaaaaatacaagtttatatgtagatttacttatatttgggggtttaaataaatgttctgcatcgctttgccgcttctcaacttgccccaaagcaaaacgaacacttccatggtgtctcttggaactcctctcctttcatctcccaaactgtcctatatctttgaagtcgtttctgaatatatgcctcatctccttcctttctgtgaaatctgacagtttgtcaaaaacacaaccctggtagccttttataggtgatgacaatgttttattccatttcccacatgttatagagccagtatataaagtaggtgctttacttgttcctcattgctacttcaaagtcatatctcaccttttctgcttcaaaaacccagaatgtttgaagctcaaagtcatcgggctgtacaaatccttcccccttttcattgttataacccactgacatttgtcattctctgccattcatttaaggctgtagattctggctcgctctttctcttcatctctacctctgcctctattctagtcaccttccaaatccacgtggccttaaaaccacaggctttcaatcccttgtcttacttgtctccaatatattttccttcaccctaactcagatgatcatttaaaggttgagaccatatgctttttcatcactcttatcagcatccccctaagatcaatcatgattccaaaagttccacactcattttttctgtctcctgatccatggttaaaacaacctcacatttgtcaattgtttttatctctttttaccctctatcatctcctcctattataataaacatagattaccagtccaaaattataatcactttcttgcaaacaaccttaactattttacctttgtctttttgaatcatgcttatctatcaaatctgggttttattcagtcatttgcttatttttatctaaaacataatctccccaaaggtacacttatattactgaaaaacactatttcagtttcctactctgcatgattattttatatcttctattgtctacataagtttaagttggctttatcaaaagcctttctgatctccatagccaaggaagttccatagctattgatttcaactcattggtactgggtgatcacagggaatctcagtgatcagagattaggtaataatatcttcccggtcaggaaagtttgaagccagttggctatctttctttctatatgacagttattcatacacgaaggtgtgaaattttcaactacctttcctggaatataattcatgggtatgtatcagtaacaatgtatgtctccttttatgaacatcatgggcaaagtatgaaaacaaaacaatcacctcttaaacgtgtcaatcagttaccatagccaagtgcactgtgacattatgattgtttcagagcggggagcatttgctgtgcatcattttatcctgaatgtttttcctaaccctgactcatggtagtcgtcctcaatatgtatttatttgaaatgtatgttttattttcctgttagatctcgtaaatatcagacttccgaggacataaatctgttaaagccttgtctcatgtttattgtttttgtgtatctcttaaggaaatgatattttgtttttatattttctgatccgaaaagagcaaaagcccctgcactcgagagagctgttacaatcaaatgagaaaatggaaaggcaaataaagaagatgtgattccctacagctgtgaacagtgatgtggaaaatatagtggcttttaggtaatatagggattcacatcctgtctctaccacttactgcttgtgtagcattgtaaaaacaacactaaatctctctcagataattaagacacggaatctgaaacacagtgggcacttgatacatgttatccctttttatactcctacctcttcgtaaggaaatatttctgagacagaataaagttcagaatcaaagtaacaagatgcttaagccattttgacagaaaatagcaaatatgtggaaaacataacaaaatatcaaacacttatataggttaagggggatgtgcccaagagctggaagaagagagattttctctataaatgattcagctaagaaattatagaatgataatatgaagctattcatctgtattcaaatttttatctaaatgcctaagattgacatgcaatatatgtttgctcttaaccatttgtaggaccttgataacatttaaaaataggtttacattcattcatttcactctccaccacattctctttttgaatctctctctctgtgcccccttctggaagcctcttttaattacttttacagagtggaaattgtatttgttaaaatatgccagccctcgatattcaaataaacatattccaattatggaaaaatgtgagatggaatatatttaataaaatgaggtctctaattattttttcactgaaatttgatcatgtcttttttttttttttttggtcttagtttttaaatgttttatttttattttatttttatcctgactgtctgcatcctacttgctcaggtaaaaaagtaagacactaaaacttgtttaaagataaactattaacaagtgttaacttaaggaaacttctagaatattttccatttggaagtctatttttcacggaaatagagccatgttgtttatgttaatttgtacccagaattttctgcttactgaaacgtgatagaaagttctatttcaatacacatatatctaactacatcattcattttcaaagaccttgtggtattccaggatataaatgtaccataatttatttagctaatattcttgaaactttttgagatgattcaaaatcaaatgaatttttagtcataacaattctctgaacatttatcacacacagcctagtgttttcaattgttttactcaaaagagaaagtcttgaaaaaatacatcagatggtaaaatgtcaatttgaagcagtgttttccacattaaaaatattgacatttttctctttgccaaatttaactggcaatttaaataacatttctgtattcatttgtcttttattgatagaagaatcaatagtattagtcagttgggttagagtgggaagagctggaggtctggaggcaggtcctgggcttagacgtggcctttgatgcttgatgttcaaatgctaaaggcattttccctgttttcattgggagagggtgagtgattactggagtttctatattctggcaccaactggccttcttatttcctgtgacacggagagcaaaatcatgaaaatgttatataccagaagcagagaattctctcctacctccaaaaagcagaagttagcaaacactgagctttgtgcgtaagtatgtgtgtatatatgtatgtaggtgtccctgaagataatttacatttttgttttatatgttttgaaactgttgaatttgaaacaattttagtttataagaaagttgcaaaattatttaatgaaatactataaacccttcacccagattctctttcactatgttttatgtacatacacatttacatacattaatatatagctattttttctgaaccaactgagaataagttgcccacattatgcccttttagctccaagtacttttattgtttatttatcaatggcattcacttaaaaatcataatacattgataaaaaagaaaattaatgtacgtaaaatgttatcaccaagactagaggtcatattcatattttgccaattgttctaatgtcctcaaggataaaaaaaaatcctggtccttagtctaatctagattcacacagtacttttatatggcatgtctgttttgtctttgtacatctagaatatttccataatctttctttgtggacttgatatttttaaggagtacgggacaattattttatagatgctgctccatttaggtttgcctgatattatcttgtgattaggtagaggttatgggtttttttttttgtttgttttgtttttttttgtttttttttgttttttttttttctttgatggagtcttactctgtcacccaggctggattgcagcagcatgatcttggctcgttgcaacctccgcctcccgggttcaagtgattctcctgcctcagcctcccatgtagctgggattataggcatgcgccaccaagctcagctaatttttgtattttttggtagagacggggtttcaccatgttggccaggctggtcttgaattcctgacctcaggcgatcagcccgcctcggcctcccaaagtgctgtagttacaaacatgagccactgtgcctggtaaaggttatgtatttttgacaataatactatcgaagtgatattgtgtttttcaatgtgcaacaaaccaggagccacataatgtctaggggttccattaatgatagtagttacttagatcatttgattagggatagtgtgattttgtcatttaaaagtatttataattttctgtatataaatatatcttatatacgttttttcctaatgtttggcatccactgagttttcttgactgaaaaaatttatgatttttttctatatggtggtttttctcttcatttttttctatgctaattaattactgtaacaaagcattttccattctttcccatttattcattcatgtgtttatttatttatttatgttactatagactcgtggattcttattttatcctatgtcttataacatattactattaagattcgttttgatgatccaattttctagatttggccagtgggatccagttcaagctggctcctgtgtctttcaaaaaaagtcatcattctaggaacattgtcttattttttgttactgtaagtttttccaggctcattttgaacatatcctgctccaattcaagaatgaagtatttatccagtgtatttccttttagtaaagaattatattaaggcatcaggagctggtcttaggtatgctcattgctactgtaatgacgtgtacatacattttcaaaatatatttaaagacactttccagtatctgtctctagctctttattataatccattaattcataggatattcccattctcatttaatattacagggtttaattttgccatcatcctttctgtgtttttatattcctactttaacattgagaaacctggattccattacccataatgtatttactatttcctcagccttataagagacgtaagtagtttgaaattgctaaattgtgccattgtgaaaagcaaaccgactcattacatttcaattaaaaatttactttaatcagagagtatatgtcaaagtacagatttcaagtactatttggtgtcttttttttttcttttcagcacatcttgactattaatttgaaacacggtttttctcccatgcttgtagattccagggatttgtttttatatgtgaaatatcaatatataattctaaaatttaaaatgatacaaaaatgtataataaaggaattgtcaccgcttctcaccttttcaatccatttttaaactcttattcttctttccaattctcaccctctccttacagataaccagactccttagtttatctttccagtgtttctttttctcacatatctgcaaatacattatattgtatctccttctctgttacagaaaccttagcatccctttgattccttttgcactttgcatttttcacttaatgttgtagtctggatatcactccaaattacctcttaaagattttctcattttttttttttttacaactgcgtaggactacattttatggaaataggcaagtgtactcaacctctctaatggataagcacttcaattgctttcaagttttagcgattacaaacaatgccttcatggataaccttgtttatatttttgaagttggatcattaaggaaaatgtcgagacattcatttccgagtcaaaggtaaatgcatacatagttttatttatattgtcaaattctcccttataaatgttggaccaatttacattcacaatagcagtgtttgagtgtgctagtttcccttgaactttgccattgaaatgtgttgtcatacttttaaatttttgttaacgtgaaaggtaagaaatatttcagtggctcacgcctgtaatcccagcactttgggaggccaaggctggtggatcacctgaggtcaggagttccagacaagcctggccaacatggtgaaacccagtctgtacaaaaaatacaaaaaaattagccaggcatagtggcgcaagcctgtaatcccagctacttgggaggctgaggcaggacagccacttgaaccctggaggcagaggttgcagtgagccgagattgcaccactgcactccagcctgggtgacaagagagagactccgtctcaaaaaaaagaaaaaaaaaaaaaaagactgggagcagtggctctcgcctgtaatcccagcactgtgggagactgaggcgggcagatcacgaggtcaagagattgagaccaccctggccaatgtggtgaaaccccatgtctaggaaaaatacaaaagttagccaggggttttggtgtgcacctgtagtctcagctactcaggaggctgaggcaggagaatcgcttgaatccgggaggcagagcttgcagtgagccaagattgcgccactgcactccagcctggcgacagagcgagactccgtctaaaaaaaataaagaaagaaataatatctcagtatattttaatttgtatttttataattgcgatgaggttgatctttttttttttgtatttttaaagttcattttttgtctatttttgggggtgattttgtcttttgctcatttttctatcgcgtacttggtcgttattctaaatcccatcactctcaatttttttttctttcatgtttctgctcattcccatggagttaatctgggtatgttctccacttatgcttcgcccaggctaagctgtcagtcagtgcagctcattctgctacccttctgctagccctgtttccttgtcacctaaaatacactttttaagtttttaataatgttgagtcagcattaacagaataaattggccacattgggccaattagtgagaagtctcatttctatttttgtggcattttaatcctttcttattctgtgtttctgtttccttggtgtcaatattcttatatggatatgtgatagtcttccttagtgtctttctactgtccatgccataacaaagttcctttctttgctaaatgtgagatgtgtacaagtaatatcttacatggatactttgcaacaattgcatgctatatgtattttcaccaccccttagttcacagatgaaaaaccacgttacagagagataaataactgaattcatacagcaagtaattgatacaaccaaattttcaaaccaggcaacctgctttcagagtttgaactcaaaaccagcaatatatatgctgcatcagataagtgtatttcattgattttgaaaactcaaagacatataatactgcatcctaagctttaaaaagacaaaagtttgttggctaatgtattaggtaaagaagttatctgattttaataaaaaagggcaaaagtaggctgcagttcatatattaagtaattacaattctgtggtgtcattggtcttgaaaattaatttatatttaatttgttatatcagatattaattatacttggtagaaggacaagaattaatacagaattcattaataaaagagtgtgctggtttattttaaactatccttagattgtatctacgcaatcaagggatatttttggtctatttgatgcgagaattatatgatccaaactgaaatgatcactggggaagtacattttcacctgataacctttatttaactgacacaattatatcaggcatgaactagtacaagtatgcattcacagccacagccatgtgcatactgcataacatctgccagactggaggcaccatgagtcactggagtaaaccaggagcttagctgacattgtcacatggtcattatcctttattattgttaagaattaattttattacaaatgtgaactaaaactaatttgaaataaaacactaataaaatgctaattaaataaaacacatgccagtactagttattaaaattagataaaaataatcagaaaacaaatttttatatcatcaagtattgtttaaatcaagtttactgtgattgaaattaccttacggttatctgtgtgacacagagatgaaggctgatcgtcaaagaaaattctaggaaacatactttttctgacgttgaaaagttgctttctgaggagtctttattcctgcagagaaatcaacacaaccgggaaactcttgtctctcatgcctgctgtttgcttattttacacaagtgacattcatcatggcttagttgatggaaactgagcaatgcttgaagttttaagactacatctgcagagcccaaataagcagaaagccttaaaataatctcatgaactcaatatagtcaggatagaataagccaggaaaatcccaaatccccatttaacttaatcaccctaacagttttaatggcacacttgtaagaaagtaattctttactggtgcccaacaccttctgtatacttcattaagggtaaaatatatggttgagtctttcacatagtccacacttcagatcgcccagaatctcattctgtgctcacatgttttgtgtgaagtttggaatcagtagggttttcctttgaaagaactcactcctccacctgccatctcgctctgtcatcttcaggtgaatgccaaatattggttctgagttaatgctgtgtggtgttgttattctaacatcccaacaggaaagtgccaattaaagggaaaaagtgttgaaaataaagttattttgttaaaagaacatacgtaggaatgcttctctcttaaatatagttatggatcaaaatacagaaattaagtgtttgcataatggaagactagacaatttgaatgaacaaataatgtaactataaatataataataataacacagaattgttattcagtatacttgtattttacatactgccttgtagggttatttccagtgattaacgtatttcacctggcatttgttagcacacaactgactgccaccaccacaggacggagaggggagtcggtgggcattaaccacagtgtaaatcaggttgtggaaatgcagaggcagtcacttgccttggcactcacacatctaatgtctgaagaagccaggacgagttcctatgttgtacattctcagtctagtttttcttactggactcgataaggaagcagaataattagatctatggagatattaagtatgagtcaacacaatgcaaaaactatcaaagtagccaatcactctttgtctttgattgttgccaacatcttttttctccaactcttattttggattcagggagtacctgtgcaggtttgttacctgggtatattgcatgatgctgaggtttggggtaagaatggtcctgtcacccaggtactgaacatagtacctagtagttagtttttcaaaccttacctccctccctcccccatatagtagtcaccagtttctattgttgccatttttaaaatccctgagaatccaatgtttagctccctcttataaatgagaacatgtagtatttggttttctgatcctgcgttaattcacttagggtaattgttgccaacatctttaatcagagatgcaatgtgtagaaatatgttagcaatggaagcatattgaaaatggacattgatactgtgtcattttgttctctcttaatgacaaggacctatctaagagagttaagttctcctttgttccaaaacaacttgtagagttgttgttcctttttttttttttctgattttagaaaaaaatatgtgccattatggaaaacatgaaagtggagaaaaatattaaaagaacaaaaatcacccatagtctcaaaaccccaagtccattccctgaagcatttttattatactttcctccaatatcttgtgtgtgtgtgtgtgtgtgtgttttatgaagtaaaattatgcagtcctgaagggaatataaagcaaaccatttcacttttccaaactaaattattacggaccatttttctattgaacaattacatcactcaatttaaatacaaagtattttacccagctattgtctgaacaaatcaaagctgtctaattacagtattgtatattgtacttttttaaaagcttgatatattcaaagatcaaaagcatgtaacaccacacctgggttgccatagagatgtctacattttatcaagattaaaaaaaacttaacaataaatgcatttttataggtatgctaaagacttaccataacttaaacacccacaaacattttttttttttgcatcaatattctgggaaaaatacaggtgcaagatattatgtgccttttaaatagcttcattttctaaacttacgtctttttttcttctgatgcatcctttccactcacctattttttagtttagaattgtcagtgaaaaagttatgtttttcaaactctggaaatatggcctgccaaactgatagtgtgaagtatggagaaaaataatgtgtatacacacattgcacaacatgtacatgtacatacatgtatatatgcacatatgtaaacacagatatgctatatgtgtatgttatatgcatacaaatgtgttttttatatctgtttctactctatgtatatacttacaaacagagcacaagcatgagattcttaaaatgtacataggacagaataaaggtcatctgatctagataagagtcatcatacatattcatagctctgaaattatctgagagtttggggaggatatttctctagggacctttaaccttaatgtcagggtgttgatttgacaagcatctctaaagaatccatcactttattagaaaaagcaaagtgtaacattattatttttttaacaacccaaactttaaaaacctttggagtaactcttatgagaaatacctgacttttgtaagccatgactacagaatttcatgttggcagtggcagaaaagagagtgcagatggagaggagcctagctttccatctgtcatagcagcatgcagaagatacactgcttattgcttcagctgtttctaaatgctgagatagagtcttgaaaaggaacaaactccaaactcatggttctttaagcagaatttgtcagctggattcaaaagaagcaaaaatgttagcatgatgaaataatatgcaggtagagcctgagaaaacctattaatatcaagtaggaaatagaacagtcagagcatggtatagtcatgttattgaacagagatgtaaaggggagaactataaattcttactgctgaagtactagccctgcaggacatacagactgcatgaagcccaggcttcctgggattttttttttttttttttttttttgagaaggagtcttgctctgtcgcccaggctggagtgcagttgtaggatcttggctcactgcaagttccgcctcccgggttcacgccattctcctgcctcagcctcccgagtagctgggactacaggcgcccgccaccacgcccggctaattttttgtatttttagtagaggcggggtttcaccgtgttagccaggttggtctcgatctcctgacctcgtgatccgcccacctcggcctcccaaagttctgggattacaggcgtgagccactgcgcccggccttttttttttttttttttttttttgagacagagtctcactctgtcacccaggctggagtgcagtagcgcaatcttggctcactgcaacctccgcctcctgggtttaagcaattagaggtgtgtgccaccatgcccagctgatctttgtacttttagtagagacggggtttggccgtgttggcaggctgttcttgaactcctgtcctcaactgatctgcccgccttgacctctcaaaatgctggaatgacaggtgtgagtcatcacgcctggccaagtatttttaaactcttggtttctagtgttattctcatcttcctattgctctgtatgcatcttttggtaactcctccctttacttgagctggcctggttctctactctttgaaccactgaagcttaactaaaaccatgccctttctaaccacagtccatgtgagttcccataattttcttgggttgttgtaaattaattcaatcatctgccatccattcatccatgtaatgcaggaaccacggtgtcacttcattcttccctccacttcactgacttccccgttttccccatctccaccctagaccctgtctttccacctcattttcaggattaattagccctcttcctccttaatagtaccctctcagtatagtcatatctcttccctgaactaccatgaaatcttggaaactgtttttctcctaccagtcttgtttctttatcattccccacatttaattctgagtaattaatgagacataagaggactttttgtttttctgattaaaggtctatcccaagtttctcatcatcttgtagtaagttctccatggcttggttctctctacttcagctttagctcctgcaacacttcctgcctctgattcagttgctttccccatgtttaaattcttgtgcacctccctcttgttcttcaacacttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagaataaacagacacagctcagagatgcctagaaagaaagctctgtagaataagtgggactcctgcatggtttccctgagaactggttttgctaagatcatcttttgcccttcagttttattgtacagcaccttcaacattaccttcctgtgattgaccatacatttagaagaatccttcagttgccctgctttaagaacacaatcagttattttagaaaggtaagattgataccaacatgaaaggctgagcagctgtaccgagtgcagagaaataagagtcacctcaggcatcaaactgttcatagtcagatttagaggaaatcaataaataaacttgctcatactttactatatttagttttgattcattggataaaatatatctttaaatatcatcataagaaagtgagtgtttggtaccattttagagtttgaatttgaaaaggatttcaagtgtgaggagtcgttctcctctggagatatttcacaggcaccatcattagtgtcaagtggagcagcctaggggggcccctttacatttattgtctttgttcctaaaagatcaaacgtagtttttccttgtacgtacagaagctaggagcttgccactttctcaggaggtgctagctctggctgaattcaatttgtgttcagaactgcccgaagcagaatttcatacatcaccagctcaggatctcacccttgcaattatccatgttgaaagactgtggcaggcagaataatgatcccccaaaatgtccacaacccccagaacttgtgagtctgccaccttttatggcaaaggggaattgaggctggaagtcagttgagagagcatactggattatccaggtgggcctaatgtaatcatatggacccttaaaggcataagaggaagaagaaaagccattctaagagatgtaataaagctagaggaagtgacgcatgagctcaagaacgtgagcaccctctagaagctgggaaataccttcagtcacagtcagcaacaaaacatagacctcagccctacaactacctgcaaagaactgaattttaccagtaatctgaataaacaaggagatggatttttccttagagcccctagaaggcctcctcactgtcatctttattttattcttctgaaactcatgttggacttgtgacctatgaaactgtaagataatacatttgtattgtttgaagctactgactttgtggtgatttgttactgcagcatggaaaagcaatacaatgagctatcaaaaacattgatcaccttatccttgatagggccaggaatgccttaaagaatatcacaatctaattgccaagaaaagataaaaataaatggaaatttcaacaatgataaaggaacaagacagtattttgagacggtaattggttgaatggtgtatagcagtgcatgataaattggcaaataaattctgctaagttttcagcaaagtcttaatgaaaagtcagaaataaatgagtctcaggttcctaatctcaagaatattttagacgctaagcacagagttgctagatagtcttatgaaaattgcttcatttaagagaaaatggcatatcattaagttgaatatttcatgatattgaaatgtagggactccagttgaatttgtcaggaaaatgggaagaaggagactgcatgagaaccaaacttaaatgtacagattggaggatttgaaaacggttgagatggagaggctttccagaagagaacaaattgatgagcatttcagagttgacaatgtctacattacctcctgagacatcaaggtcaatgcacatgtgccgaaagccactcacaaaattgaagtccatcctccaactccaggcccacacttactcacaagcataacttcctcacctcaacagtgggcagtacataatttctgaaaatgagacaatacagagtaatctctcatgcatctttctttgatgtaacagagaccagcctgagttgtaataaatttagggaaagcattcactattattttggtttctaactcttctcaatctgggacaaaatgaatgccactgaaaggcaagaaaaatactcagataatctctcttttccagccaaatatgggagtattgaaggaacaaggagatgacagataaagatgcttttagagcagctcctaatgctctctctctctgttcctaaatgaatatggccaaggctgaggaggtttctacttatgagaaattgtccctgaaagtactccagctgctcactgactcccaggcctaaggatagtcagtctagaggaagatgctgcgtctaatatctcttcctgcctagggttccgtagagtctagtttctgtggaaagccatgtatggcgataaaatgagtgtgatcctcttagcaagaaggcatgggtggaatttctgccttccgtgtttgctaataaggggacttcatgccaattacctaacctctctgggttttagttttttcatttgtcgatggcactgatgatattaatggagcctctctcagagtaagcacttatggatttttgtatgatttttaatgcgatgagataaatcttcagtaaaatttgaagtattataaaatgttagtattcttgtagttattattgcattaattttctagggcttctataataaagtactgtcgattgggtggcttaaacagcaaaagcttatttcctgtggttctggaagctggaagtttaaggtcaaggtgcccacagggttggtgtcttttcaaggtgcccacaggattggtgtcttttgaggcctttctctcgggcttgtagatggccattttctccttatatgctcacatggtgttccctttttgcaggtatgtgtccaatatttctcatatgagaactccagtcacattagattagggctcaccctaatgatttcattttaacttacttttctctttaaagaccctgtatctaaatgcagtcacattctgaaaaactggctgttaggacttcagcatacataattctagggggacacaattcagctcataacattattacaattattaattccagttcagtggttaaaataatatttttgcattatgacagtcataactttatctattaaaaaactgaatacctatttcacgttcctttgaggctttataatcacaaagtcaccacttctcagaaacaaaagcaagctggcagccttgctccactgtctctcctttgctcaaatggccactgaaaccagtgccttggcctctgtgggctttatcacctttgacatgaaatactctcttcacagtataatctcattttttgtgcaccataagggaatccatttgaaatgtagaagttgactccaatgacaaaatacatatgaaaaatagtaactttctgtagtaactctaaatttccttctgggaaaacacacaaacgtacacgtgtacacatacacacacacaaccccccacccctccaactgctaaaattttcatgcctaattgatattttccagaaaaccatttaagctgctttcttctattatggcttctctcctaccaggcacagaaactgtactgaatattagggataagtttcagtagccccatttgcattcagtcctcagacaagcgaagacatggacagtgagtaacatttatcctggggaaactgatcaagaaagagaagccacctggataaaacaagtcaaggaaatttgcatactcagaaccatgatttgagatgctaatcattacagaagcatgttttattggtccatttaatttgatttggagagaaatctccctaaaggatttggggattttgcagacctaaggcactgacatacagagtaaagttggattttactatattacttgtccctatggaatcagttcatcaaggctgctaataactaaagcagtggctttcaaacttgaatggctttaagaattatctggagagcttgttaaaatgccacaggctcaaggaattctaactcattcagtcctgagtgggatctggaaacctacacaatatcaagcccgcttcctcaccccaagtgattttaatttttctaaccaacactcacatagtgtttattatatgtcagacactgttataagcattttataaatgttaacttatttcaagtcacacaatttttacattttttttcccattttttacaggagagcaatggagacagagttgcttatccaagggcagtctagcaagtggcagagctggggcatgagtccaggcagttttgttccagagtccgtgctcttggtcaccttactttgatgcgtatcctccaccagcacactttgagaaacaccacagtaaggaatacgcacacagatgtgacaactgcccctacaaagcaaatcattcctgtcaattatggatacctgtctcatttattgaaaacctacttcgtgccaaggactctggtagacagacaagttttttaaagcattacaaaataagtgtgaaaaacaaaatcctaaatgagtcttgattaacccaattgggtctctctgtggcctaatggtggaaccaaatgatgtagcagaaggaaagcaatgtttctgtgtttccaaatgctcaaactgcttctgagtacaccctgggctccatccagtgcagaacttaagaatttgctcctatgttttttactttttcttttaaaccagtatttatttggaaacaatttcaaattgacagataatatttaaagaataagagtagtataaaagaccttcatatacatttcactcagaatcactgaccattaacattttacctcattaggtccaacagttgcaaattctctctctctcagtttctctctgtccacataacgtatacacattttttaaaaattaattttaatttttgttttaagcttcagtgtatgtatgtacaggaagtgcaggttcattacataggtaaatgtgtgccatagtgtttcgctgcacctatgaactcatcacctaggtattaagcccagcatgcattaactatttttcctaatgctctccctcccccactccaccccctggcaggccccagtgtgtgttgttccctccctgtgtccatgttttctcattgttcagctcccacttataagtgagaccatgtggtgtttggttttctgtttctgccttagtttgctagctctacccatgcccctgcaaaggatatggtcttgttcctttttatggttgcatagtattccacagtatgtacacaattttttaaccattagtgccattagcattttcttatgggggaagtattggtactttgtcccagcaaataaaaataataaatgaaaaagttggttagagtgtaatatatccacttgtcacaatcattttagcagctttagaaatgctattactgaaattatttatctggaatcagttatttcatcatatcatttaatttccaattgatcattataatcaacattattatcataactgtttttattgagcacttgttatgggcaaaaggctttttgcattatcttattaatccacccaatattataatattataataatcctctctgtctctgtgacagtaattcttcctatcttcctcttcacatgtgctcctgcaggcacgctggcttccctgtggatctatgaacattccaggcacatttcggtctcatggcctttgcatctgctgttctatctactggaatattattaatcatgatattaataaatgaattcttgcattttcttcaatgattcactcaaatatcaacactttagtgaatccttccttttccatatcatttaaaatttcaacacttccctaatattttctttcccccttcattgttgcctcattcccatcttacatatgtcaattacattttttttcccttaaacattagtttcaagaggccaagatatttttctattgggtgtattcctgtttagcaacccagagaagtgtgtcagccatactgaggcctcctttaaatatttgttgaataaacacccattgttaaggtacggaaaatgaggcctagagaggttagatcacttagccaaagacaagtttcgggaaagtgtcaaagcaaatatggtatcaggaaattgcctgtagggcctaaattctccgtacgtctagtcagctgggagaaacctgaggaacataattgagtttcgtcttttagagttttacattctagagcttctatgctcttggtggagaagctgatgcacacacttaatggctctgatttttgttgtcacttgtgcccagcttaactatggaaaagaatttgatttcataagaataagtgctcttagtagtagtactagagacacacctcccatttgcaaatatacttgctattttcctagtatttttacatacattgtttcattttacttcataatgggacagtaaatccaggttcattatcacctttgtgtggatgaggaattggaagcccttttgggttagtgattttctcgaggtcatacagcaaaaatgtggttgtatcagaactagggccaaggttcccaatctctgacctgatttttcaccaacaattttcttgctcagccgctcatgctactatactctgttatacaaaataactcttctaaataaataaaccaatgctggccctataaaattataggtatggtaagaacagtagtctcagtggtatctgcaaattcctgtattacttcattaattttactcagcagtaccaaagggttttaggaagttgagcaagaagaccccctggtcatttggggacagacatttaacaataaattgagcctgaatcttatagtccccaaacctgacttcctgagtgaccaagcagagatggaatttaaggaacaagcatcttccctgtaagtcccatcattgtgttcaccacaaattacaaatacttatatatgaaatatgcatctagaggcgttaccagtggcaactccatatgggtctgggtctgtagcaactctattcttgccttctttgaggaaagaatttggctgagggacagaaggcagagtgagagactgaggcaagttttagagcaggagtgtaagtttattaaaaagttttagagcaggagcaaaaggaagtaaataaagtacacttggaagaggggcaagcgggtgccttgcgagatccaagtgccccatctgacccttgacttgggtctttaatatattggtatgttccaaggtttgggtttcttctcccctgatttttccttgtggcaggctgtccgcacgcacagtggcctgccagcgtgtcggaggtgctgcatgctcagtgtgtttactgaagttgtgcccatgatcacttggcatttttcccttaccagtcgagtgctgcaagaagaaggtcataaaccagttaaactctgccattttgcctgttactgcacatgcttgagctccacttacccagctcctgcgatctcatcaggaagctgctcatcaccagcttcaggtgtttcccatctattgggagactgcctttccctggcaccagctgcaaccaattattattttagagcaagtttgacatctgcccaaccgtctgctaatggtcacctgacatttctgggagtgatgctctcttgccctgctcatgtatgcctagatacctactctaacagaggtattcagttccgtaaaataatagatttgttgtcattgtcagtagccatcagttatgttttatatttccaagcagtttttaacttcatcacatctcttaagagcaacagccgtatgtaacttttattattaataacccagtgatgttagtataagtaataatctccttaattaccacattccaaaaaaatgtctcggggttgttaatggcttatctaacatctcacagttaatatcacttattctcttgaatgcaagtctgtgcttttgtcaccacattgcagtggggcaggagaaatatctggcatctactaggaacttagttgacatcagctttctctttctaattctctcttccctataattaaattatcttatcatcttgcaactttgtgagatgattgcgtattttaatctccgttttgatgaataagaaagcctttgtaatggatctcaagaagaggaatttaaatccaacaaacaaagagaaaatagtgcactgaatatttgcattgggttttatatgttccaggtcacatttcaaagttgcctttctgttagacttcatagttgtcagggctactaggaaacaagttccttgacggctcttttagaattatttgcactcagaattctttggttctattccagttatttactgttgcacaacaaatctatgtctaaggttagtagcataaaaccacaggattgcattctatatcatagttttcttgggttagaaatttgaataaggagattattgtcttccactggatattaacggagattgcttgatagtgttcagttgcaaacgtgctggtctggaaagcccaagaaggcctcttggtgccttggaaaggataggaccctcgagtagatggtgcctggatgagatggctgggagcctgggttcaccggggactgttgaccaaatgacacatgtggcctttgtgatatgatgatttcaaagtggttggatttcttacatggtatctcagggctcccatagagcgttttccaagagacaggaaacaggtagtgtagcaaaattagtaacaccacttccactatattctactgatcaaatagtcacatgcctgttcagattcagaggaaagaaggaaagaggtatagacacaacctctcagggagaaaaacatcaccaaatttgtggccatctttaatattcacatttcatgtagttctactctatgaggataagcatgctggtatctgatctggtcacagtctgaactgtacagcaaaggatgagggtagtgaaatgtggagtgatgagcattagaagatgctttttgcctctgaggaggatttccctaggcaaaaagtggaaagtagttaaaattgatctttgctgttctgtttgctattaatcttgaggtgaaggttctggcaaacatgttgaataactgaattctgctctagcaaacaacgcccgccatccccatatctactaagtttcctaagaccatgtttcccaaactgctgcaattctgtatcatgttgaccatttttaccatatcagggtccttcttgaagtattgtttaacttctttttctaacttaatttactccattttatttaagttttaagatacatttttcatcactcttataaatggaaagccattatcacttgtcataagtagagatacttctgaaaataaaaccattatctacagcagaggtgagcaaacgtagtggtcattggctaaatccagactttggcttgtttttgcacaatctgcaagcaataaaataaagaagggagggatggattatggacaagaaggagagaaacacagagggagaaaggaaagaggaggaaaggaagttgggaagaagggaaaaatggaggaagaaagaaagaagaatgtagcaaagaccatacatggcctgcgaaagctaaaatatttactgtctgtctcttcacagaaaaagtttgatgaccctttctctagagctatgcttttcttcttgcttgtccttccaatgcaatattatgtgcttgtgtttgctgcctgcttagaaagctgcatttgatgctgtgtggtgaccaacaaatcaatcatgcctcctttccatggtctagagttgttgctgagcagcagctgtccaggcgagggattacaattctgagccatggcatctagtggagccatgagaatggttcttactaatggtacataaacaaaagtgatgggtgtcattttgggttccaggtggttaaatactggttgcatgatccttcacaatctctgtcctctcatgcctttgtctgccagttgaaagatgctttgtttaaggaaataagatattttgcaatttacactatgggatctgatgaacagttgtcagccttaaaaacacatacccattaatttttattgtgtcccattggccataattataccaaaaatacatatgctggcgaagttatagtagcaataaccttattacagggtaactattatgtgggcctgtatgtgacagaaattggtagttaagaaataatactgattttcaggctatgagggcaaaatattgcttgtcaaattcattcagggatattttctgagtcccaaaagtagatgtgagctaagaagtaaattaatcagtttaggatttctattaactgaaattccaaaggtcttaatattaacaaattacaatgattaactcagacataatttcagttgcaggcatgggtaatccagataatggcatgttgaagacatataatagaataaaacccatgcagtactaaaaaataaataaatacataaaagtaggttttatttagtcaatttatcaaggttactatttgttgttgctaattgcagtacttttcatgtgcaaaacactgcagtttcttaaatgtgatgtcaattagcctcacattgaataaaaaaggtaaataagttttatcaagttttcttcctcctctttcccttccttcctttcttttttcctttttcctcaaagaaacaaagataccatacagtcaagtagcttgtccacagttatgtgagcttttctataatccattggtatcttccctaccatttccattttctcctcaagcagtaagccctttaattcatttttagtttatatttctagtttagtgattttttttaacataagcaaatacatatgtggacatctatctatctatccacgtcgccacttcctcacacaaaaggcagcaccctatacatagttctacactggtttttttgcttattttctatttaacgtatatcctggaaattgccatagcaatgtataaagatacctttaagctttcttacaatcacataataatccaatgtgaggatataatatagtttatgtaacttgtcctttttgatatgtatttggaggtgtttctagtcatttgttcttaaaaataatatcaaaggccaggtgtggtggctcacgcctgtaatcccagcactttgggaggccgaggcaggtggatcacctgaggtcaggagttcaagaccagcctgatcaacatggcgaaaccccgtctctactaaaaaaaatacaaaaattagtggagtatggtattgcatgcctgtaatcccaactactaggaggggctgaggcaggagaattgtttgaactcaggaggtggaggttgcaatgagctgagatcgtgccattgcactccagcctgggcaacagagcgagactctatctcgataataataatgataatatcaaaaaactgagaaaatatgacagcaaatgttcttagaaaaacttagaatgtatgataaaataccattgtcatacattctctcatatttggctacatactttggaaaagattctgagatgtaggattactgggtcaaaaagcaaatgcatgtacaattttgttgaaaaaatgccttattacactctctatgatgtttcttctgtatttcattcccaacagtaatggaagaaaatgcctgttttcccacaggctcaccttctttcccaagacaggattttggctgttttcttctgggaataaaatacttctcagtgtgatgctttttgttttgtttttgtttttgttttttttccattttacttgtttgccaatcctattatttatgcaaaaactacacaactttttttaagtttatattcccactaatcatagtagcattatattcttacttgagttttcattgcactgttctcataaggaacttgagtatcttttcatatgtttaaaacttttttcattttttattttaaaatttttgactgacaaattaaaactgcatgtattctaagtatatatgtgatgatttgatatacatatgtaatgtgcagtgattagcacaatcaaattcacacattcactagcagccatgctgcacattagacctccaggacttgttttataactgaaagtttataacctttgaccaacattgtccttttttcttttcttttttttctctttctttttttttttttttttttttcttttgagacggattctcactaagtcgctcaggctggagtccagtggcacgatcttggctcactgcaagctccgcctcccgggttcacgccattctcctgcctcagcttcccgagtagctgggacaacaggctcccgcgaccacgcccagctaatttttttgtatgtttagtagagactgggtttcaccacgttagccagggtggtctcgatctcctgacctcatgatccgcccgcctcggcctcccaaagtgaacattgtcctttttcctactccttagcctctggtaaacaccattctactctctgcttctatgaatttgaacttttaagattccacatgtaagtgagattatacagtatttgtctttttgtgtcaggcttatttcatttaacgtaatatcctccagttcatcaatgttgtcaaaataaaatcggtatcttgaagatacacttcgtgcacccccatgttctttgcaatctcatatttattgcagcattgttaataatagccaagatatagaaacaagattagtgtccactgatggatgaatagctaaacaaaatgtagtctatgtatatacaatggaaaattattcagccatagaaaagaatgaaatcctgccacttgtgacatatttgaagacattttaatgtctttccataaagtgtttgatcacatgttgtgtccatttttctttcagcttgctagttttattcttcaacattctttgaagctttaaatattaggcatactaagtttttatcagtgatagaatttacagtatctgagatataatttacaattaatctaagatccaagtaacaattattacaattattactctaagatccaaaacacaaatatttattgtagttggtcatattttgcttaggtatttttggcatgtaaactattatactttttaaaaacttatgtaaaaaatctattgaccttttccataatgcttttggaaaaggaatatatcatctctaggtaggtgtataaagaaaataaactgttctctttaatacttgaataatttctgcttatttgcatctcttacccattgggtatttgttgtggtatctgtgtgtaagaaatatttacaggctttttaaaacttttatgtttggtgatctagttcctcatatgccatgtatttaaaagttaatcttttcattaatgacttggaaaagcatattttcatttattcatatagcatatctttccttttagtgtttctctcagtttcaaaaatcattcagtctattcattaaccaatatttatttaataaaatttgtaatacagaggcttcataacggcttcaatatatgatggagttggcttaccctaccatcatgaagaggatacctgtggaaccttcctaagaaacagacattgatcttccaaagcaggtgaagctcaaatacagcaagagtcgcacatagctgcatacctggggcatgccacatggaatcatgtgttgcacacacaggaaacaaagggtgtttttaaatgtcagtcccacatcaaaagatgcaaaggcaaatgcttttagtagcagaatttgatttgtaattgagctttttctcccaaacacaattctttttgtttggggtggggaatgaatttcagcaactccatatatgtttgttgaacaaatgaatgaattaaagaatgaactccatgaactaaaggcaggaatttccatgctcaagtttgtaaaatattcttctatacaattatagttagggcaaataacaatacaaaaatatattcaggtatgcctagaccataagaatggctcagactggattgtactggaaaaatgtatggatctgattattgaataaaataaattattacttgtaaaacgaaaaattggaaaagagccttagcagttgaatataaaatattaaagagtattaaaaatgacataggcattcattcacttgaccagtgttcgttttatgcctactacatagctagcaaaaatctatgatgaattactaaagtgaacagtgtttgtacacttaagataaagcatttagtaaccacgaaactcctgcttgaagtccttaaaaccatgaaatgtcaaaccaaacccagattctcagttgacagattgttgtattaatccattcaccaaaatgcaaatattaatagagaatgcatttttattttatcaatacatgctttaatgttgtctgaaatgtttggggaataaagaagagaagtaatggctttaaaagagttaagttcatgtttacccaggtggacaatcacagtctaaatgctgattaaaattttaggtcaacttggagggaaagaacctgagatcactcacagaattctgctcaagtgccttcctactttccgtcaataacgtcaattgatgtagagaggattttttacaaatataacttatgaacaatttaaatctggaagagcaagcaattatggtgaattctagaatcaatgctcagaatcaaaaggctgaaatgacacatcaaagctagcaaaatgaaatcaactggaatctaacaggttgacattccatgttttaaaaacataattataaaggtaattgtgcaagaagtcatggaataccaaagctcagaaacaaaagtttaaacaaaactttaacttgagttgacattaaaatttaaagtataagtaatatcctaagactggcattcataattgtgcagatattttccagtattacaatggatagtttctgccaaataactcatctaacagacagtcatgcatatcggtatctatactttcagatacacattttttcagcaaaccaggtactgtaaagtataaggccctataatgttcttttcattatctaaccctctaacactttgaagcacattaattctttttatctccctgctttttgtttccctctcattctgacttacattggttagccaaaggagcagcagagtattgcagtctgagattaaagtgaacctgctttccttttcttttttttttttcccccatatggtatttgttttctttattattattattattattattattattattatactttaagttctagggtacatgtgcacaacgtgcaggttagttacatatgtatacatgtgccatgttggtgtgccgcacctgttacctcgtcatttacattaggtatatctcctaatgctatccctcccccttacccccacctcacgacaggctccagtgtttgatgttccccaccctgtgtccaagtgttctcattgttcaagtcccacctatgagtgagaacatgcggtgtttggttttctgtccttgcgatagtttgctgagaatgatggtttccagcttcatccatgtccctacaaaggacatgaactcatccttttttatagctgcgtagtattccatggtgtatatgtgccacattttcttaatccagtctatcattgatggacatttgggttggttccaagtctttgctattgcaaatagtgccacaataaacatacgtgtgaatgtgtctttatagcagcatgatttacagtcctttgggtatatacccagtaatgggatggttgggtcaaatggtatttctagttctagatccttgaggaatcgccacactgtcttccgcaatggttgaattagtttaaagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagtattgtttcatgtgtctgttggctgcataaatgtcttcttttgagaattgtctgttcatatcctttgcccacttcttgatggggttgattttttcttgtttaagttctttgtagattctggatattagccctttgtcagatgggtggattgtaaaaattttctcccattctgtaggttgcctgttcactctgatggtagtttcttttgctgtgcaaaagctctttagtttaattagatcccatttgtcaattctggcttttgttgtcattgcttttggtgttttagtcatgaagtccttgcctatgcctatgtcctgaatggtactgcctaggttttcttctagagtttttatggttttaggtctaacatataagtgtttaatccatcttgaattaatttttgtaaggtgtaagggagggatccagtttcagctgtctacatatggctagccagttttcccagcaccatttattaaatagggaattctttcctcatttcttgtttttgtcaggtttttcaaagatcagatggttgtagatgtgtggtattatttctgcagactctgttctgttgcattggtctatatctctgttttggtaccagtaccgtgctgttttggttactgtagccttgtagtatagtttgaagtcaggtagtgtgatgcctccagctttgttcttttggcttaggattgtcttggcaatgtggactcttttttggttccatatgaactttaaagtagttttttccaattctgtgaagaaagtcattggtagcttgatggggatggcattgaatctataaattatcttgggcagtatggccattttcacgatattaattcttcctatccatgagcatagaacattcttccatttgtttgtgttctgttttattttgttgagcagtggtttgtagttctccttgaagaggtccttcacatcccttgtaagttggattcctatcctatcctattttattctctttgaagcaattgtgaatgggagttcactcatgatttggctctctgtttgtctgttattgctttccttttcattcctgacaggcaaggtgagcgccctgaacaacacagctcccctgatcttttccccctacctactaaagggggttgtcctcctaaaggggcactgaaaaatcactgacatgaggcagattgattgataggagaaaagatgtacaaatttatttaatgtgtacacgtgagagccttcagaataaagacccaagctaacaataagatacagaagcttttatattaatatcatcttagttgatagaaataatgtggactcagagcatgccccacaacaggttttagttgtaaggcaggttataagagagagaaaggaagaggcttgactggcaagggtggtcttgttaggtaaatgaagcttccctcagagaaaatagatggtaaatgtttccttttagacttttaaaggtgtcagcctctcaatctctcttagttctaggaaaggcatacaaaaggccttagtaagctgagcgtggtggctcatgcctgtaatcctagcactttgggaggccaaggcctagcactttgatcatgaggtcaagagatcaagaccatcctggccaacatggtgaaaccccgtctctgctaaaaaaaaacaaaaaaaacaaaaaaaaaaacaaaaattagctgggcgtggtggcttgtgcctgtagtcccagctactagcgaggctgaggccagagaatcgcttgaacccaggaggcagaggttgcagtgagtcgagattgtgccactgcactccagcctggtgacagagtgacactcggtctcaaaaacaaaaaaagaaagaaagaaaaaagaaagaaaggaaaaaaactgaaaagtcctgggtatattaatggaaattctctacagaggcaaaatttttccccaaaaaagatacctttgcaaggccacttctgtttgctggcactgcagcaggcattttataatatgtgaaataaatatatttttggataaaatatatttatgtcttttggtacctactttgaaacttaaaacaatttttacacattaaaagccaagctgattgctttggtagaatttgtgttaagggtcgttagttagagatagccaaaaaagtagaaagataaattggtatatacagaaaagaacaaatttaaacatattgtttaaatcttctttagtctgttagtcatgaaaatatatcagttcagttaaacaattgtgtctcattccaagaggtggcattgcagatgggctttgcctttacgtgtgatgcaggcaaccagctctctaataaagcatttctatggaaacagaaggaaaacaaaggttgatgcatggcacggtgcctctatagactagcttttctagagtttctagggcatcctcagattgcaagggcaacctgacagattcttctggattgtaatttggaccaagagttcaagtgaactttctgagaaatccacacatcagcagggaggcatgaaggttgttcatatataagttgctattatttttttactgacgtttaagttgtctagcttcaatttgcagggctttaagaaaagcacagttttaatttctaataattccaagccagaaaaatggaagaaaaaatgggaaataaaaaaatgttagtttggagacttgtaacaagtaaagaattcagaattcagactaaaatgtagagaaaaaatgaaaactcaaaactaatggacaaggctagaatctaataataggtatatgactgtctcttttgaaacataatttttctctctctattcccccattttttaccaaagacaaatcatagcaggaccaatttatttgcaacacaagttttagtcttattatacttggcttgattaattgcttaaagttcaacaggaatcattgttcatataggcttttagacgttggctttgctggaacttttttcataaggaatctcagattggacttttaaaaacctttcaagcccagccaataacttacctctgcctgcagatacctattatgaagtgggtaaattcctctcttcttgaagtcctcaaaaaacttgagattcttaggcctgtcagaaagtggcattctttacttaccataggtcaggaaccctgcaaagtaaccatgtagacaagagaccagtcattccaaggggctattattggctctataaaatcaatcttaattcctcaaagcattctggtcatatctaaaggtatgcccttccagctgaagccatgctaaattaaccactatctctatttatgtcctgttaaaaatgaaacagattcttactcaacttacacaaataactatattgccatgaattaagaatacttacaaataatttccaaattctggagaaatcagacagaaagaaatatgcttctaagtttgtttacaagagtatatttactcagttgttaaaagctataaatagctcaaaagaaaaaagttttcttgactctgaaaaacaaaacataaagaatcagcaatgttttaaacaaaaaaagtcataaaaaattatttcagtatctaatagtccagtcccatgcaattaactcctgttcttcccgatattacactaacaatcctcattaacactttagctctccagtgaaagttctggaagttttttctctagtccaatggcacaatctccaaaattaacagaaacctgctttcaagcatgcctatccaggtcctttctatgaactccccataagaagcaagttttgtactctagctgatgataaaccactttttgaggagaatcaaagcaaaacaactgtggatgacaaaagtcttagcacagccatggtgaaagacacaattgacaaggaaatttggttacttctgtggcatacaaaaatttatcataatagatataattattactgacaacatactgagacatatcagaattatagaaatcccatactattttggaacacacactaataacacatttatataaatataacccaaataaagttaaacattattttatatttcacaatgctttctatatgattttaacataccaaataagctgaatatgtctttcaggggacctaatatctaaaaagctaatgaggtcaaaaagacagaatttgaaatttgattttggaaagtttgtcaaatatgtaagattttaaacatctgatgtcaaaaattaggcaaatattttagaaagcaaaaacatttatgctttgagaggagactcagtttcttaaacaataaggcataataaagatacgaagacaactgaatctgtctttctcttccctttttttgcagtttactcaacaggttaaaaaaaatctgttactatctcttactattaactgaaaactttatccaaaagagaaaacaaaattttacttttcaatagcatattattaatgctaaagcttatttcaatgaaatcttatgaacaaactcatccaatctcaaacagtttgaccataaagtaagatttttatagacccttttataaaccttaataattttctattaaagagcagatcaatgttccaagaaaaccattactgcaacacaaaggccctgattctggccctgtgtcagtgtgcttttgatattaatgtttaatttatagaaaaaatgaaataattccctttaaattttagccaacttgatcacaaacaaaattccttttttaacattaatctgccataaaccttctataacttacttaaaccttcagtttttttctaatattttactttaggacaaatatttcctttcctccccaattttctatatccgtttagttttatccatcatttttttctttaatttaaaacaattcttataaacctttaaatgagtcagaattactttttctttaacaaaaaccacatttccatgttttttataacctttttacacgtcctactttattatatgctttgtatatagaattgtttcttttatatctagtagttttaattttatttattacagtgttgactgtaactcttgtttttagtggaaaacctaggaggtaagcaattttaattatgtattagattcagagcccagaacaaaggacagagctgcagataatgccttaccctttcctgcatagccaggaggcatagctaggccaagaagaactcatgtctatttgtttagagcctagaatctaatagttgtaaaacaggcaagtcaaatatttgtcaaaaatatcacacataaatatcacaatttatgaccttaaaacacctagcaaaggcagtatctgacctgcctgtgtaattcagactgaatttctaaattaaagtctgaagatgtttccattttatcttaccagtaactttcaaaaactcttaatttaccaaagattagtcacatgaactatgaaactatgtgaggtaaaatttttatttttctgtttaaatatttgatttaagtattttttttccttaagacaagtaattagagctcttttacatattttagtaatgaaacatcatatgtgcttataaatgtgtataaacacacagacatacaggcagagaaacaaatcttcacttgtcatatttcaaagtttctctccagtattttagactatcagtctcttgattacctgttttcttctctaagcaattattagctaggcaaccccaaatgtgcaattctaaagggacagctcttgtaaaacaaagtagaaaatttatatcttagagtacaaaggtaaaacatttggcctaaatattgtatcatcatctgctcaaaccacgggaaaaaattatgtgagtaaaattcagttaagatgaccagagaaagcaccttaaacaaagagatgacttgtaaattttaaacaatggtaaacacttttaatgtacacaggtaggcaccctttcaaatggagatttccttaaatatgtaaatttcttttacaaaagagtgtcaggatagctagctaaatgctagaaagttgtattttggctattttacttaactcgtttcataattagatgactagcttcagagtggagccccttggtgaatatgggaagaaaagcatacagtttttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatccaaaaagagaaaaaacataaaggtcatatatacatatatatacacacacatttatatacattatatattaatatatattttatatgcattatatatatttcatttacatatataaataaaatgtgtgtgtgtagcttagatatcagcttttaattaagcagatttctaactgtagtgctcactcctcaaaaataaaaaaactttcaaaatcttattactggatttcagctgggacaaatagcttgtcttggcttttgaactcctttaccaaaggtctaaagcagtcctcataagatctagaaatatcaaatcaaaagagactaagtgattccttcatcagaccaactcttctgtcaatggttgagagaaagtgttactctcaaactatgattgtaaagttgtctatttctcccttgaaatctttcagatttttgaaaattctaaacttcagttattaggtatataaacatgtatgattgttgtgacttcctctcccttttatcattatgaaatatgtctctatgtttggtaatactaattattttgaagtctattttatttgatattattattgctacttcagccttctgacacttgtagatctttttccatccttttactctcaatttctctgtgtctttgtatttaaatctttcccttttggatagcatatattggggtcttatgggccttttttttaatatttgaacataatctttgccttttaacttgagtgcttagcccataaacatttactataagatacattcagatttagttctactattttattactggtttctatgatggtcatcttttattttctggtccttatgttggccatctttcattttttggtcctctgatctcccttccctgccttcttcttaattacttgaatatatttttagaattcaattatttctttactagctttttacctatacctctttgtatcattgttaagtggctgttctatggcttacaatttatatcctttataatgaacaatatataacagtatacttcaatttttgtagcattttgtgtaaaatatagaaaacttgcaatcatataacaggtcactatcctgtaattacagttgccatctgaattaatatacacacagattaaaaatccataaataattttataatatttgctttaaagggtaaattatattttgaagaaatttttaaaatagggcttttttatatttactcataatttaacatttttaatgcggtttgtttatgatgaaagattcaagcttttcatctggtataatttcctagtttctcttcagcctgaagagcttttttttttttcattaataacatgttttttggagtgtaggtttgacagaaataaatttccttagtttttcatttaaatatgtatttattcgatattaatttttgaaacacgtctcactcattttaaattatgagatgagaactttatttatttattttttacctctgtaaaggtttctttttcttccctgctctcttttgttcttcatgggtttctgatgggaagtctgtttttattccaattattacacctctaaaatcatatgttattttcactgagtagtttaaaattttctcatgcttttgactttgaacattttgagtatgattatctacaaaatatattctgaatttgtcttatttggcatttgctcaactattaaatttaacatcttgttcatttaccaaaaatggtagttatagtcattatttcttcaagcagctcttctgctccattttctttctctccccttctgggactcaattacctatatgttaaaacttttgacattgtctcatagacttcttaggccctgttaggttggttagaatttttaaaatctctctcatcttttggtttagtgaaatttattgacagattttcaagttcactggccattttctctttcatctcctttctcttattaagcttactcagtgattttatttcagatgtttatttatttcagttctaacatttcactttcttttttatattgtctgtatctttgctaagattttatactctaccttgaagaacaaagttataagaggtgctttactagcctcatacgataattctagcctctgcaccatcctgattggcatctgttcattattaatacctcgatattgggtcacatttgcagcctttctatattgagtaattttgaattgcatcctggatatcgtgagtgttagttatgctgaatatattctggattctgttctattttacctccaacagattattgaaggtgtttattttggcaggcaatttacttactgtcacacatatagtgcattgtagctcacatctcacttttttttgtaatttttagttgtaagttgctttaattttgcccaccatcctccattcaccttatgaatggtcccagtggtcaaccaggaacttaccttgagtttatgcactgaattaagggttcctttttcctggtctctcctttctgtctttgactctttgggagccattgttaccccagagcgccgtcacctgttttttttgtttgtttgtttgtttttgtttttttgatgagaagtcatttttaacctatctccactgcagcagcagctatcttaaggataaatcaccaataaaatagggattttacgctatgctgccccaagttttgattcccctttagaaactccctgcttgcttcatcctccaaagccctcagctagttgtgtttttgattttatccagcatttagttatttgtgtaaggattgtttttttaagagcttactcttcaatttcaaacacccaaacttcctgttcaataatttttgaaaacctaagatgataatgtaataactttctctcagatgaataagtattttaatagattttctaaaatccagtaaaacatactttggaaaaggacaataaaagtttttcttaaaatttttatttacatatcaacttaattaaacgtgttagctgatttccatgtatatatggaagatcagagaactaaattcttcaggtaatctatttttgcacatctttgggaaaaagatttctgtttgattgcctctaaagcgtagctcattcacatttaattatcttaagaataggccacttgtaacattaatccacaaagctgaatttataatttgtaagagatggcacctttgaagttgacatttcttttatatcaatgagattgcagctgcagatgaagtgcaaatggcaaattatgcaaaataaaataatcacgaggggaaacttcagttgaatatttctgtttgattaataatctatcagcagataccatctaatttaaatttgcacaaaagcataactgctgttgaaaaattgctgctgtttaacggggacacaaattcacatttctttccctcctcctctttgtgtagccaacgattgcagttacttggttttgaattgggctttttagagttaatgccttgaaaatagaaaaataataaaaagctttccttcatcctatttatgcctattcacctgcttatcatcttcaagtcttttctaggtcctatgagactagaatcattattcagttttgcccagttacctacttcttaaaagagaaatgtcattcagattctttaaactatagcggatagtcattgttctggtttgtcaaagaccaccttaaagtggtgactagaattgaaaagagaatttatttaagtaagcgtgatgaatctaacttttctcattatctggactataaaatgtcattaaggtttcctaagattcaattaggtttctttgttttttaaggggttggtttctttatgcgttttgtttctgtagcaaccctatcactcttgtaacagcacaacacaaacaccagttacccaaatataaaaacataattaaaagctatgcctttttcacatcagataatgccaagtctgggatatattacctgattctgtaacgtagataaataccttaaatgcattgttattaaaattgaccacagtgataaaatttgaccacttgacagaaattctaccctattaaagactaatctttagagagaaaagaaaaaaaatattacttgggttaatgagcttggatgtggatttagaaggtctaattcccaactagttgaataacaataattgtatcactttctttttttaaatggagacggagtctttctctgttgccggctggagtgcagtggcacgacctcagctcactgcaatctccgcctcccgggttcaagcgattcccctgcctcagcctcccaggtagctggtattgcaggtacgcacaaccatgcctggctattttttttttttttttgtactttaatagagacggggtttcaccatattagccaagatggtctcaatcttctgaccttgtgatccgcctgccttggcctcccaaagtgctgggattacaggtgtgagccaccgcgcccggccaattgtgtaactttcaacaactcatttgacctctaaaatttctgtttctttaattgtaaaactagatttttaaattaaatcacctgtatcttctcttttattctaaaaatggacattttcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctcgaacacatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgaggaaaaaaatacacctgtttgcaaggtgacatttctttgagggctcactcatggcacagcctggggatacacagaccacgggccaacatctgtggggaactcagagctttgctaattgcattcatcatattttctggggattcacttagtgctctgaaaaagccagataattactggttatttaaaaaattactttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgttctttggagaaaaaaaggtctatgtttgagtcaaaaattccatcatcaagacacagcctgtggtctcatattttcttcagttggtgacaaggatctgtgaattgtgacttggaacaggtgggcgcacacccaccccccgccccgccacccccccaaaaagaaacaaaacccaactctagtcttcatgacagtggcagtgaccaggaaaataggacagatctgttttctcagctttctctgcactccccagtgtctagagaggaaggtaagcaagggtgtaagctcaggccctggtgtaacgtttgggcataacagagctgggctggaacttggcctctccactactgtgtgttttcgttgttgttgtttttttttgttttttttttttttggatttcttgacagctctaaccacgtaaacctaatagcagagaaaaggagtaagtgtcagccctgccatgtacaacgctgacatattttaaaagcaaacctttgttcaaaataaatcttaaccattttagagcactgctatttcttcactggaatttggatcagagaacaaatccagtccactgacaagatgtgagagaaacacaagagtttctttattctgtaagataaaatatttatgagatgatttttatcagaaggcacttattatgtagcaatctttacagactctatgcttgctgcagagttatctatgcaaaatttaaactaaaggaaacctaggtgtttacatcttaagaaagacatacatttcaaccaacagaacatgtgttatagagttgtgttttataaaggtagagtggtaaacataccttaggctaaaggaagaaaaatgatagggatatgctgcaagctgaataaacctcccttctagctgtttttttttttttttttttttttttttaagatggtagcttttgagacagtgctatctttcaggatattcagattccctttcaaacaaatgaatattctgtgccctgattgcatgttttgttaagttgggtgatgacagtggattcttagggttgtcctcctgagagagtagccccaactctattttcggagtttttctattctctagtctttgtatatgccacagacatttggtctctgagtcctcagtcttataacaatagatcttaagctttgttatctaaaaaactatccagcttctgatttaaaaccaagctgcctaactgtaattctcatatctgttatttcttctaagatctcagaggaatgctctcaacctggactattttagctcattcaatagaacataacagcagtctctgagcctgagctggttagccaccatagttctgttctgtcagggtaattgctatcatgattcacaactagtgtctcttttcttcaagaaactgtcactcagatttaccctaccttcttcacctaaatccaattctttagatcataacctaaatctaagcctttttcatttcacaaccctacatctgcaaggttcttttaattattctctgactgtctttcagttttctaacatcgacagtatagccttgcatacttttcatgaggtcatttgctttttgaaaacataagtagccacctccttcttaccatactgcaaaaactcctgtgtaagactgtttaggtcatttaaagtctgcacatctccaatttcttctcttgtacttaccacaagaatttaagaaaacattaattaccgaatgatttatgatattttcagttgcattttactctaatttgatatatctttataagccattgctaatttgttataacttactgcataaagagagtttgatagagggtttcatgatctctcaacaaaatacgaagataggtagatgatagtaaagttacagagaaaacaatctccaatattcacctgctctataggactaggtcatggaatacctttacaaaataaagaaatttggagattgtcttttttggcaaataatgattaacatgcatttttttggatagaatcaatttttgggatgtcacaagggttatataatttaatgctgataagaaacataatagtatcactgtttctctcattttgaaaatgagaagactgtgagctagagagaatacatatatcataatttttctaagatgaacaaaaagatcaaaattttaaactcttatcaccccaggctatctctgtaaatgatctttttaatttattacctgcttttggtatatatttccccagttttgtatgatttgcagctttttaaaatattctgattctttccattctaagcaaagaagaagtgcatttttctccagaatgtaagggaagtactcggcatttgatcttaatttcgctttttttacagtgtagaatgaactacagataagaggggtggaaagaaagaaaagggagagaaagccaacatgagcaaatttctattaattgtcagatcatgacacattccagccaagaatgttcctatcttcttatcaacaaaagtaaaatttactctctctctctcttttttttctcttgtaaaaatagaaacttctgacttgccttttaagctcaaaatcaaacatttctggagcacctagtatgtgagaggatcattttctctatcaaacatcttcccaacaatattatgaatgcaaagtattatgcagaattgtcaaataaactttaacaagttatgtatctgatccagattcacaaagaaatccaaactccaagttatcatgacttcaaacttctatgcctttgatattttatgtatcactagatgatattgtgtctttcaaattcctaatgtagaattgttggtaaaatgaagctctctagccaaatttaaattgacctacgagttaataaaaatgtgctaatttctaatgcaaaatcttatttagcatttttaataactaaaacattcctattgatatttgctcacaaaattattttattgtctaaaaataaattgctcagtaatgtttgtttttaagcattgataataatttgaggtggagtcttaattcttgagagaaaaacctgttcttaaaatcctgcagggcaaactcaagcattagacctttatttctcaatatgttctttcgctttttttaaatgaaattgccaaaaaaagaatagattcaaatttaaactaaaagtctagaagctaaaaccaagctaaacaaaataacactacattaaaaatataagtagatgaaaatgtgctatattttcttgtccacttcatcctgtgtaacttgtcactgagcacccattaatttcttttaaattgtttccttcactttcctcttgagagctggagtgttgaatctagcagcagatcacagctacttataaacacttggctgaaggactctcaaattctctgcaagattttgagtaaagtgaacctaggaattctgaagggacaccctttagtcagtaaggaaagagcgttcatctattccttagacttgttgctgctatcacagaagtcaaagttaaaaacacagggtatgaataccagtactaatttcctggactgattatcaaggagctgtcctctttcatggtcagaggctaatataagcactcctacaacaaaagcaggaagctttgtttctattttcttacccataacaatctttgtcctttattgatatgggagataaaaagtggtgacaatatcagacaaaaggaaagaaaagaatgcgagctttcatttttcctctcctgccttgatgagaagcagtcaaatgcaaccaaatgcccttggccatgtgaggttgggatagctcttaattagtctgcaactccaaactatcaaaaggtagggaaggcaaggatcctaggaagaaaaaccaaatactcacagacaattaaaaactaaagcctaatagttgattaatgaaatgatgtcagcctgcatgaagtgcccttatgactttgtacgaatcccttacgctgtcttaataacttggatactgatgtcaaagaaggtgtgcttatcatttttggcaaaggcataactatgagagacagagttaatatatttgaaaaaataatgcaaatttaattcaaacatttaataataatataagaaattagatgttttctcacaagataaatttaacatagatagggataaaagcccacatttagtaaaagggaacatatgaaagcacacatatttacacagatatatagggagagatgctacttaacaactgtttatgtacaaaaaatacatgagcgttttagttatttttagcacaacacgagtcaatagcattatgtggctactgaaagcattctcctataatttcagttagcacttttagaaattgtgctaaagtaaaacaagaaaattgttctattgcattctttgtcatatcctttagcatttattataactcagtatcattaattcattttttacttatttaatgtgaatctgttccattagattgtatgcttcatatcacacttgttttattcactaatccttgttcaacctatgcctactacagtacatggtccaagatgtatgtccttggtgtcttatatatagtatatgaggaaaatttggtggggtaatgtaaaggaagtagacgcctgggtggaaacgacatacattatatcccaggaaacaggcccagaatcaatatgtagaaaccagagaatgattaacttaaagtcttaaagattaattttagaatacttagaatatcatatgttgtaactattctaaagtttataagtagtccaaaatggagtagactagacttctgtttaaacatggtggaataataatacttttctttctatggcctaagagacaccaagtcagctgagggcacaagcactaacaaaacaggaagacagtgatgattaaatccttattctggctgggcgcaatggctcctgcctgtaatctgagcactttgagaggcagaggcgggcagatcacttgaggtcaggagtttaagagcagtctggccaacatggtaaaaccccatctctactaaaaatacaaaaatattagacaggcatggtggtgtgggcctataatcccagctattcaggaggcggaggcgtgagaattgcttgtatctgggaagcagaagctgtagtgagccaagattgcattgctatactccaccctgggcaacagaacaagacaccgtctcaaacaacaacaataataacaataacaacaaaaaacagacaaaaaaaataccctgcctgccaaacgtactctgtcatgaagaaaattggaaggcttttatccaaaagtgggacaaaccaagagaaaagatgcgacattgccatgtagttgttccaaataaaatggggacaattatttggaacaactaatgttgttctggtcactctacagcaaggatcatcattcctcaaactatgtgataagaagttccaacaagcctttagcatctctttcttaaatattaatggatattcagtgatgatcagatatgtgagcagagcttctaacatgaaaggaacaatagtaagaaaactaaagaaatagaacatgaaagtggggagtataagaagaaaaatattaatatccaaaatgaaattttaaaaattcttttgttaatgacaagatgatatcaaaaggaacatagaatccatataaattatgttagacaaagttgaagacattgaaaaagaacaagaaaacttaggcatataatataaaaggagaaatataaaacaaataaaagatcaattcataaagatcaagacaaattccaggaagaaagaaccgagaaaatgggaaagaaacaatctatgaacaatagatggagaaaaagaaaatgatttctgctagggcacatcattatgaaattcccaaatgtagaaaataaactattccaaagaagaaacagcagatttgaaaacagaggatggaatctcagaaagggtcttcataatggcagtattagacattagaagacattaaataagcatcttcaaaatactgaggcaaaataattagcaagctagtgatccatatctggccagcagagcttattagaatgaagacatcttcagacacacaagatctcaaaacaataactttctcaggaaactactagacaatatgttgcgggaaaaaaaaggatgaaaatcacaaagaaagttgatatgagattgatgtctaggaatcagaggatccatcacaggagagatgaaaaaagagtcatcaggaagatagtgaagggatattccaggattccattttttagcagtcccagagagtaactaacccagataaaaagaagagaatcgtaagctctcacagtgaagtgttcaagctaaaaataagtgtaaataaataaataaatacctctcttctcccccaccaaaaacaaaaaaaacaaaaaaaccctgctaaaataccagaccctactgtgacatttccattctactagtagagtttggggataaattcgttgtcattacagagaatagtaagaaaaaatttcaggaagaatgagtcattaaccttagtgaaaccaatattgtatcaagtaaaacaatgtaattaatggctcagctgtgaataatatttataaggtcatgaatagtgaaacgactgaaaactgattaattttaaaaactgaaatatgccatattgaatggttggaatgaatagttaagagctacaccatcatttccattaatcagaaattaatacagaatatctaaaattacaaaatcaagaaatgatgtacaacagttatcaattgcagaatattcaaacgttttgtagcttaaaacattaagtatttattatcttacatagtttctgtggtcaaaaacatggtactggcttcagtgtgtgaactgagtctctcataaggttaaggttaggatgccagccaagcctgcagtcagtaaggcttgactggtactcaaggatctgtttacaaagtgactcagtcacatggatggcaagcacatactactgttggcatgaggcctcagttcccctcacccccccatggacctcacctgcataagactcaagatatggcggctgcatttccccagagtaaatgattcaagaaagggcctgtaatagggaaatgtcttctatgactagtcttagagggtacaagttgttatattcacagtatactattagttactgagatcaaccctattcatcatgggagaggacttcatgtgggtaacttaccatggggaacagaggatgatatgggccagcttgaaggctatgtaccacaagcagtatgagtgtgtgtgtgtgtgtgtgtgtgttttcaacatgaagtgaagtttaaaacgatttgcattacaaacataaaagagctacatgggcagagatcctagtacttttaaaagaactgttttataattatccatgtgaatgaaactacaggtctgggaccttcttttcctgaaatgcttgtatatattgggcagcttaatttgtttactttgttattattgtaagagatcttgagtaacctgacaataagctatatgtgctctttaaattctatatatctgctctccagtaccactaccttggtgcaggcagaagtgagtacttggaattggctttttgtattattattttgaaaagaaagaagaagaaaatcagtaaacaatagtgtcctaaatgaatatctttagaaataacccttcttagtagaccattgatattcttcggcatttcaggaaattaatccacccacttgataatggttgaaaattggtatcttaagacacagttgtttctcccaacatatcgatattatatcagactgatgtatcttgcattctcccagtaaaaaggaaatagaattttaataaaagccagattgtgcaactaatactctggaattgtagtgcattttttaaaatcttcatgcaggaaatgaaagagaaaaaaagaatccagatcctaacttttcagtagaagagtgaaatgtaaaatgattttagaaaatagattattttcaaatttgtattcttcacttttgaagaagagcgtattttcctcctggatacataatttggaaacatatttcaaaaaccgaatcttaatctatgcaatgaacatatcaaaaagtaaattactatcttcaagggaatgaaatatcatattagagaagcacactctagcaccacagtaattatggctttgccaacatttctgtgcaaagtctgattctgaaacagttttttcttaccccacacagccttgtttatgtaagaatttagtgtttaccccaaccttcaaatacaagttgacctattgttttacttctttaagtgaaactttttgggactatatgactttctaacttcctccagaaatatgtatggttctggatttcctccgtgcttcatctactgtagcttacagaagagaatgttatagaattattgcattttagaatcgaactttgaagcatgttactgaagccatatcatgatgggggagcagtccagaaatatttttaaagcactagtcttggagtcagaagctctgtgttagcctacctacttattagtagggttgccttgatgaagtcacttgattttctgaaatatttctctctctctctctcaaaaatctgtaaaatggaagcaacaaactcaatggcttttaagatctttgtaacctccagtgttactcaagtttgaatagagagagaaggtgagaaacaaatctagaatacacatctcctaactcccagtttggcatattcacaaatgttagatttatgatgattagtgagaaaatataactattccaaatacatttctaggtatgtgagatatattacaatatggaaggaaaatgataccaaattgtggctcttctctatggccctcatcagggaactattctgaaataataggacatgtgtctaaccaaatccatatttttatatgctcatcagcttctaactatgtacttgacttgatctattcttaatgtcaccaaattaacatcttgaggaagcatgaaattttccaaaaagaatctatgagcatttggtggctatttgccagaaatatttctcctggacaaaagatggaaagccattctggaaagcaagagtgttttattagaatacagcagtgctttagtttaatgtgatcattacccttgtaagtttctaatcaactatttgcaggatggttttacaaatatggtttgactaacctcaagccttattttttgcatgcgaaatctactaaaaaatgcaacattatcattattgcatttacatatttcttccacatgtataacaaagtagaatgtatctccctcgttcttaccaaaaacctctaatatagtgacgtgttctgccaaaatgtaataaatgagaaagcatatgctttgcaggcagacatactgggtatttggaatctcatttctgcacttcttagctattatgttcctgggcaagatatttaatgtctctgagcctcagttccttcctctgtgaaatgagactaataatactgctctcataaagctgtattaatatatattctaactatatatgtgaaattacataaaattatgaaatagagagagtggtatatttagctccgttagatgcattaaaatgctaaacatctgtatcttttttttttttaaccagttttctttcaatcacgataaagtcatgacaactggtaactttaggaataatcttaccactaggcagggttgataaatcaattgtataaaatggtacataaatcaaagcctatgtttctctttttaatgtgtgtagccacaactactacatgaccttcatgctttactgctgagagaatacatatttagacaaaagctcaaggagttgcattctactacataacatgcagtggtttgtttctgtgactcgctgtggaagtgatttctaggagcgccagatgcttggatgctatttttatatagatagaaagggaatcccttcatttattggatgttcttggcatggtattgtgtgatttggtgcttgaccaggtgggagtctcttatttatgaagttcagaaaattccagtgcttagccaagtctctactgaatgcccaggatatacttgaaggttaacagtggcataaagtattagtgtttcctgatttttatatgtggatagaatatcttttggctcttggtttatacagattcttgcattattctctcatgagctcagttcttggccttaatgcccttgagttctttagggctacttcctccagcctttttgtctgacatcactactgcctctccacgatgtaaaatctgcactgtgattcaaagagatcccctgcatatagcagagtcattcttccaatggtttcctctttctttttcatttcaattcccacaagcctccatcttcagcaagtctgttgctgacaggttgaacaaatactgctaagatatatttattctctgagaccctttttcacttagagtaaatatgttactgtctcagttcatgttccagcaaaacgcagactctaaggtatggatttcagtacaaagagattacttggcaggtgatcttaagaaataccaatgagaaagtgggataaggaagaaaaggtacaataaaggatcctttgggaagcctgctagcactgtgggcaactgagattgaatcctttggggagcactggagaatacttaactgagagtgactcccatgcctctccacaggagggaaaatagtatactcagtccctgatttaaagctgatcccaaaggcattaattaccaataattctgtagactgctgatggagagatccaaaaaagctttggggcagagcaacacagctgttcagctggaattcagggcatgcactgaaatggtaagagacaatgggataggagcagataaccaaagtgtctaccataatcacctttaaaacatgctttatgcaattatagaattggaaattattttagagaccagctctcagcttatgagtcacaacaaggttattgataatatcgtaggtgggataattctttattgggcagagttagctccgtacattgcaggatctaccactaagcaccagtcagacacccagttattttgactgcacaaataaccatttatattttcaagtgcccctctgttggtcaacattttctctgagcaccacagttttataggggaaggaattttttttgtttttggtttttgggactgagtctcactttcttgcccaggctggagtgcaatggcgccatctcagctcactgcaacttccgcctcctgggttcaagcaactctcctgcctcagcctcccgagtagctggtattataggcatacgccaccacaccagctaatttttgtatttttagtagaaacgggttttcgttatgttggccaggctggtctgaaactcctgacctcaggtgatcctcccacctcggccaggcgtaagcaaccgtgccaggctagggggaggaattctaacttggcaaggctaagagacctgctaaaaggcaattggcaaccagtgtccacgtctccagaattatcatagagagaaaacagaaaccttctttttgagggagatcatctctgagatatttttacctgggtagcagtgaatcctggatacacagaaatataatataatatttgagtgaaataagtattaaattattatgggagctaaacaaattgccctcaattccctatctgtgcatttttatctgcttttaaataatataaattattattacctatgtccacatgcagaggcagaggaaaagagaatccctttaaaatgattacaagccaacaaaatatttgcaagtgaaaacatatattttgggggaactgccttgttattttaagtttacattatacctactttaattccagaatgtcattacagaggaaaaaaaaaagcttgattagctgagtaacatcacttttttaaccaatgcactctcctactgcttagttccttacagctggataagtgggtaacctttgtgtccatagattcttaggtagatggaatctattgggaaaggaaatcaattttacacatatacatacacatatttttaaatttcagactgtttttatctaaaatagaagcacggattttgagtccccccaaaatggatattatttgtctcattcgatggacttactataaattctagaatggcgggatgttatgaacggcatcgcacatgctacacaaacacaaattctgctcttacgattacaccattacaagataaatgtattctcaagtagctgcagtattctattaaaatgtagacacaagcagaatcatttttattaagaaaaaaagcagagcaaagcatttaaaatataaataaaatataaaaacaattgctttcctattaaatacaaaactagagagcactgtttcaaattggtaagtcatatctgtttaatatgattgcaattatttatggggattaggaaaattaatgtcaaatctaatattttcgaaaaatggaagactcaattaattaaccagacatttcatcctggaatcctatttctttttctttccagagggaacctaaatggagattatattagagaattaagtttgacagttaatttatgaagaactaatattataagtatcaattaaatagaggtgagggatatatggaattagtttgagttgttaaactgaccatttcaaaaattagaagtattttatcactaatacagatttgagaaattattagcaattctaaattattcagatttgcttaaattcaatgattatgatttagatgaattaagaaagttactcagtttgtttaaactgtggaagttaactttagtgtcccaaacctgggacattagcttcattttatttcggctatgccaggatatatttgaagctcgtattctgtacaacagtgtatactattgtagagaatggggatggataataataataaaatatcactttgtcagtaaataaatattcactgaatgataattgtgtgctaaggaatttatatgtatattatctcattcaattctcataaaatctgtgtgatagggcccagtatagttttctgttttccaattgaggtaactgggtcacagagaatgaagcctcgcaaccatggttatgccgctactatgtaaggaatttgctttaatcccccagtatccctactctaatctaagtcagaatctagacatgcagatcaatacaaatacatttcagcctaaaaaaaaaaaactctgaaagcacatttccaattttgccagcagttagttattcatctacagaagctattagtcccagtttgtaacattagcaaaaattaattttcagtctttttcttatagtttgtcttggtagcttttgacaaagttggccataacctctctctggataggtgacaaggtgcagtagtgcaccttgtctttcagaacagcaatactcttctggttgacctcttattcctttgacagtgacttctctgattcctttagaggtgtctcttttaatttctaaaaaatgctgatggttttaatgtgttatttttatgacacatatcccccttgggaaattgctcttgttcaaccaccgtctcatgctactgactgcagtgtagactgctctatgttcaatcatctactggaaaccaccgttgaaagcttgaggtgcataacttagacttatattttctcaaacctgctctcatactcacttaccctcactagaagtcctctttactcctccctcttttttacatgtccccatgttaaatttcattattcagtcttgattcattgattaattatttataatttataattttatattttagaatttttttcaggtgctggggatacaattatagacatgattaagtactagtttcatgaggcttatacagtagttacccccttaaccatggagggtacattccaagacccccagtaatgcttaaaaccatggatagtaccaaaccctgtatgtatgtatgggtatatatatattttttatatatatatatatatacacacatagcatatatgtatatgctatgaatacatgtatacatatatgctatgaaaacatgtatacatatatatttatgcataacacgaatgaagaatgcataacaagaatggagcaatgcatttaaaatataaataaaatataaaaacattactttcatattaaatacatatatgtatgcataacaatattttggtaaactatagactacataaagacagtagccctataagattataataagatatttttactatatcttttctatgtttagatatgtttagatacacaaatatttaccattttgttacaattgattacagcttttaggacattaacatactgtcctaggagcctaggatcaataggctatactacatagcctaggtgtgtaggaggctagaccacctaggtttgtgtaagtacactctatgatgtttgcaaaacaaaatcacctgaaaactaacttctcagaatgtacccccatcattaagtaatgcatgactgtgctgttttttcctttatgtccatacctatgataaaatttaagatataaattacacacagtaggaaattaatcacaataactaataataaaatagaactattgtaacaatatactgtaataaaagccatgtcattgtggtctctctctctaattttattgtactttactcacccttcttcagatgacatgaaattacaagacacctatgtgataagatgaagtgaggtgaatgctttgggcattgtgacataacatttaaaacttgaattatttctggacttttccatttaatattaagctgctgttgaccttaggtaactgaaactgcggaaagcaaaaccaaggataaggatggtctcctgatgagttagggttgagaaaacaaatctgtaaagaaacaaataatatgctttctactagggatgagtgttttgaaaaaacataaaacagatgagtaaataaagagtgaaaaggcatagcattttatctaaaatatacattgagtgcaatgtgtcagttgagtgaactatcttggttgcaaaagtcattaaggctcttaggagtcgtgaaagccttctgtgagaaggtgattttggtcacagtaatgaatgatgaaatggtggaattaatgaagagttggtgaaagagacaaataagaaggaaagcaagtttaaaggttctgaggagtgaacaatttggcacttcccatggtttcatttaactgtaagatttgcttccgaaaatatttctgtctttggtatcacttgtcttactaggtactgtaggctttgggctttttctaaatccagtattcactaagcagtcagagtttctggtttatctacacatacaaatccgtttatatgatttcagtgcttatacctttctagatttccatgtacaactgtgcactgcaaaacactaaggaatagcattcacttagactaggatgtaagcattactccatggagttgtgtgacatgctggccctaaattccgtgccatcgatagcgggaggaagtagaaatcctttgacaattattttcctcttgatctaggatacaccctttgctggagtctgatttcttataattttctactactacatgctacattgtggtagtttatggttctgttaccctaattcccttcctcctccctgtagtgacttccttttctggttaacacgttttcattctttgaacttcagctcagataaaacatatgtggagcagacttgccaagtctagattaaatacctgtggtgcaacactgccaaattgagagacatttgtctctcaatttttcatatcatttgtagtttttttttttttaagacagtctagctctgtcccccaggctggagtgcagtagcgtgatctcggctcactgcctcagcctccccagtagctgggactacaggtgcgtgccaccacgtctggctaattttgtatttttggtagagatgggatttcaccatgttagccaggatagtcttgatctcctgacctcatgatccgcccgcgtcggcatcccaaagtgctgggattacagacgtgagccatcgtgcctggccccgtttgtagttctaaaattcaagtctggatatattagttccccgcttaaaatgcctcatgtcttcccactttctataataaaaagtctactatccttcgcatgacattgcctttattttaaatctccttacaattctcgcatctttttcttgagagtcccattgtcaagtatacacttacggtttcctgactaggccaagtggttcccagcatagctctgtgtaaccctctggaattctacagtcacctgtccatctccaaaggctcagtcaagtgtcacatacactgtcaggttttttctgacccaggcatagaactgcccttctcagtgtctctgcttttctctgtgtggacttctatcacaacacctattatcatttactgagtttagtcgtttgtttttctgtcttcttttgtaaactcatggaggatgagactttatttctgaacagtggagacagctggcacctgagagttgcttatttgagtagatgaacgagtgatttaaaaaatttgggaaggatattgaaatgaacctaattgtggtaatcatattcttaataaatacaaactgagacaaaagatttattctgtgaattttgttttgccctcaaaataaagtagtatctcatttcatacgtagtatgttggaatgttttgccatggctgctatactgattggcattgctcactgctgttcgttgcaatatacaccagctgtttttcagcagaatgagtggtacaccttaaaagccaagtctttctccccgaacagagcgctgggccaggctcaaatctgtcatctaatcactcactgtgtgctgaacactagtctgactttccacgtgatctttctacactttttacacacacgcccacacattatttatgctcaaaagaatgatctgttatgagagtacagtgaatgtgttagtttcaagagataagattgtccagattcagaaacttgtagctgtcatcttctagtttcctcactgcaagtgtggagtaagattggtataacattagttcatcattcttttcagattagaaaatcttacatggtcatctgggagaacagggcaaaacaaaggtcaaatgttatggctagaaatcaagcctgcaaagcaccatcaatggaaaatttgtcatattttatggagaaactataattcttacaaatctctactaacagttctggttgtgttgatgctttggactgtctagagagtcacactcttctgtccattaacttaaaagcatgactttttagtatgttcatttccccatatggggtacaagattagtaatatcgtcttttaccaggtactttctctatgatcatggacatttgcctattctaatcagatccctgcatagttatttaggtaacttccttgaagaatatagtactaaggcagaatgaccatataatttattattgaagttagataactttttgagagcgaagaaagcagtacccatagttaccccaggatgacaggcataaattgaaatacgtggtcaacgtagtatatgggagacatgacttttaggagaaaatatttccaaataactcaaatcttaaaaacctccagagacttcaaacccattctgaaaacataatttgctgttcatatctcaaaataacatggttatcacctggggatagaaagatcatgacaacactgatgtgtgccatgaaattctttccatacttacatgaggttgtcaggtccaaactccaaatgcagaaaaacatgcagagaattgtagttcttgagcatctcttcttgaattagagcataacaattaacttttaaatcatttttggatactattgccaatgctttttattttgggtatctttttaacttaagtgctagctttcagaagtggaaagaaggataaatactgtaattatccttctattataaaatattacatttttaattacagcaattatttctagctacaaatctttaaatgtatgatgttttacttatgtttgataataaataggcaatactttgtgatacacagttgacacaagacaaatctaaataaaaaatgagaacatgagcccccttaattttatggattgttttttaaactgactttgcttctatgcaggcctttcactttctgtaaacacttaagggatattttttaatactctgtaaagtaaatttcagaatggaaaacataactccgaggtgtattttcaatccgcacaattttttttcacagaggtgtagaaaacattctacctgttattaaaaaaaattctatgtatttttggtttgtttgtttgtttgtttgagagggagtttcgctcttcgtgcccaggctggagggcaatgttgcgatctcggctcactgcaacctccgcctcccaggttcaagcaattctcccctcagattcccaagtagctgggattacaggtgcctgccaccacgcctggctaatttttgtatttttggtaaagacaaggtttctgcatgttggccaggctggtctcaaactcctgacctcaggtggtccgcctgtctcagcctcctaaagtgctgggattacaggcatgagccaccacgcccagccacaaattctgtgtttttaatagctttattgagatataatttacctgctataaagttactcatttgaagtataaaatttaatagttttagtccatttatagagttgtgcatcatcgtcctaatcttgttatagaacattttaaccatcttctccccaaaaaaccttgatcacattagcaatctctccccattccctctgctgtccacccctcatgcagcccccagccatagacaagaactcatcaactctctgtctctatatatttgcctctttggaacatttcacaaaaaatggtattatacaatatattgtcttttatatctggcttccttcatttagtatgtttttgagattcataggtgttgtagcatctatcagtgcttcatttctttcactgtctaatagtgttccatttcttggatatactacattttatttagtcattcctcagtgggatctttgggttgtttccatttttgactcttaatgctgccatccacgcaaaaggtttttcagtgtttcattttattgtcttttttttttttttttttttttaacgtatgttttcttttctcttgggtagaattccacctaggagtacagttgctgagtcatatggtaactctctgtttaaccttttgaaaaattgccaaactattttcaaaatttgctgtaccatttcacattcccatcagcaatatctgaggatcccaatttctcttcatactttctaatacttctacatcttttttaatataggcatttcagtggatccctaatgataataggcacttctgattgtttttgtaaataaaatgttattagaacacagccacccccattcgtttattctttttttttttttttttgttttttgttttttgagatggagtctcgctctgtcgcccaggctggagtgcagtggctctatctctgctcactgcaagctctgcctcccgggttcatgccattctcctgcctcagcctcccatgtagctgggactacaggcgcccgcccccacgcctgactaacttggttttgtatttttagtagagacgggctttcaccgtgttagccaggatggtctcgatctcctgacctcgtgatccgcccgcctcggcctcccaaagtgctgggattacaggcgtgagccaccgtgcccggctccattcatttattcttattgtctatgggtatttttgtggtatgatggcagagttgaaccacagagacaacatggctcacaaatcctaaaatatttattttctgaccctttacagaaaaagttcaccagcctctgctttagcgaatcaaaaatttacgtcctcaatcatgttttatttacaagtgattggcgtatgtcaggatgtttagtgagcgatacaggagtatttcattgtatttggagggaatgattgaaatgattttatacagataatcttctgaatttgtgattggtgttatatttcaatttatcaatttattcatatttatttaacaagttattacatatatatttattcggtatagttgtgaaagtcttattatatgccagtggctgtgttagaatttaaggataatgcagtgaggagcaacaagacccctgctttaacagagcttacaatttatggaaagactgcctcttactctgaggaaggtgggagtcatccagtctacagtggagctgagggcctgagggaaagaactgttagaacagatcactggtacaagatctgtagttctgaggaggagactctcctctttgtataatttctcagagcctttaccgtatgaaatatgcattgcatatctctagcaagatttccaaggtacctgagcaccagatctcttagtttgatgaagtatttagggctccacgaaacattttctgaaaaaaaaattacatagaacattgttggtcaagaattgtcagatgaaaagattcttaaaagaccctagaaacaaaacgagatcatttactcaacatctttctttttctagtgctacgtgaccttttaatcttgaaatttttcttgtgtagatgttaggcctgtaaattagttatggtaatgtcaattcaaagcgtctttgaagtttagtttgtcctttattggattcctgtctttcatatttgtctttctaaagcactttaaaatcttggagaagaaagttcaaggaaagatgatataatagattattcttccttgggctgcaatacttttaaaaggattattccttatctttttgttaaattgacttctataaatttttcaaagtgaagtgttttggttctcaaaggctaggagtatccttttatcttctttttctattctctcatattttccttccttgacaaattcatggctgaataacagtatcgaaatgttatcataattctttggctaattatttttgtcaagccccccaaaaggcaaaaacaagcactgtttaaaatgtttagtttggcagcatgagataaattagaagtgcagagaatgagcaacctatgagatcatctgtctgctgctacgtgcagcccatcacaattctagactgttagaaactcaagctcaattacccactttgctattcagttcctgcatactttgcgtgaataactgccccactctgtaactcagattcctcagctgtataatcaatggagttaataatacttatttcagttattgtgaagcaccgagtagatggttggcatgcaataaatatagttaccaacctataacattggtctaaggaatgaagaaacatctgttagaaagacagctttttaaatgaaaatactaatagtgccctgaagaaagatttatctttcttagtatgtcacagttaccagatggaaaaatcagcaaaatacaaaacacttaatgaatataggtatcatgatatcattatgatcataaggaaaaaagtggaacagttagatggggttataactggtaaatccatacttgaacgagatgtctaacatttagagtggagttcccctgggtttattaaaggttagtgttctctatcttccccagggagaattttataaatatataaataacgatatgaattacctctttggataaatatataaatgctatttaataaaaaaaaaatgtgtctgacctaaagctggaagggattgataatacgttgaatagcagaatgatgaccataccatatggataggtgatgtggtaaacctaatttgtgagctaattttttttgaagaaatgtgagaaagatcttttttggattcacaatattatcttcacaaatctttgaaagggaaaatgtaagtgtggaaaagacttcagtatttaaaattactgtaattgcaaaataagagttatagtgtgctaaggagatacttctgacaaaaacagtcccatgtaactatagccagatcaaattgatatgaagtatctgcaacagtggagattattgacctattcagttttagacttcattatgacagtgttagtttcagtggagctactccattctgagggacaaagataaacgttaaggtattcaagaaaagttaaatagttgtgggcagttgttgataaaaggattaagacattaagaatagccatgtagtttggaaaatcaactacaaaaaattatatctggaaatatctttccaaaactagctttgacatttttgtttctacaactccatgtttaggcatgtaacatgaaggaatctctcctcacgtaaaagaaatgcctagggttttaaattccagcatagttgtataatattgaaaactacctaaggtgctcattgaataatttatgtataaccactgagtagaatagtatttggccataaaaaagaatgaagaaagttttctctgaactgatataaagtgattaagaagatatatgttgtaaagtataattacagtattttaacttttgtttcacaaataaggaaaaataagaatgtatgatattttttctctctcttgagatatctctatatctgtttgtctatttgtctgaatctgtctgtctgcttgggtatactttcctggccaaaaagaaaaaaaaaaacaaaaaacagaagtataaacagaaactaaaaaatagttacctctgtagagtaggtgaaaatgggatagagggaataagaatcggaatgtaagttccttgaaagcaagaaacttgctttatatagtaaactctttatgtagttgacgttttaattataaaaatatcctatatatttaaacaaacaaaattaaaaggatgaaaaaatcagttgaatcaatcagacatacatgatcttaaccaaatatcaaattatttactaccatactgagaaaataataatttaagtaacttttacttgattaattaatttgtcaattaacgtactaattcatcaacaaattaagattataaattcaggtaacattattcctaaaaaactccatcttaaattcatctgacttttctatatttcaatattaccatttccccatgatttatacatgcttagaaagataaattctaaagtccaatacaactgcaaaaatatcattagctcttgttttttattatagttgtattggtgtggtcattctcacattgttttctgtatatattgtatgaaagaattagtgagtaaatgcattagcatggttggaagaaaggaggcacaaatatggaatgggtatgtgtggaagaatgctttagtgttggattttctttagaagtatcagtataaccctgttagacatagacacatacacatatttaatacaaacttcaagcacattttcatccatcttaaatttatctgactattctatgtttcaatattaccatttcttcttgattgaaggatgtcattatgcctgtttgtgcatataatgaacagatattgatttctaaataccactcactaaacacacattgaaaactgggaaacttaaatggctgatttcaggtctgcaacaagaaagaacaaattgggttatgccagaaagcaatggcatactcaatggttaataggataaggttgaaaaggcacagatgctctgtatagggaatttattgaccacatttggggtatgtagcttcagtaagaaaaatatagaataacatgttgaattacaaaaaaaatccaagagtacatagtaatacaagagataaaaagaaagacaaaaatggcagttcttttaaaaaagaattatgtgattttattagcccttcttcaccctattgctgatagagggattcctactctagtgttatatggatgacagaatataacacctgacactgggcagatgagatcacctgcagttcatacacattcatactcacatatggcatacatatatatactctcagctaggggaggagagcaccccatgccacagaggcccacacaggttgcacttgggaacaaagtgaataaccagggactgtggacagcaagatttatagtgtcaacagagggaaaggccccagtactcatgggaggatgtggttggtttagttatttttttattttaaaatgtaatgtaaattaattttaagttctgggatacatgtgcaggatgtgcaggtttgttacataggtaaacgtgtgctatggtggtttgctgcacctatcaacctatcacataggtattaagtcctgtaagaattagctgtttgtcttaatgctctccctcccctcaccccctcaaagggccctagtgagtgttgttcccctccctgtgtcaatatgttctcattgttcagctcccacttagaaatgagaagaggcagtgttttgttttctgttcctgtgttagtttgctgaggataatggctcccggctccatccatgtctctgcaaagacatgatctccttcctttttatggctgtataacaatccatgatgtattttctttatccagtctattattgatgggcatttgggttgatttcatatctttgctattgtgaatagtgctgcaataaacatgcacatgcatgtatcccagtaatgggattgctagtcaaatggcatttctggttctagaaatgccatttctggttctagaaatgccatttctggttctaggtctttgaagaattgccatgctgtcttccacagtggttgaactgatttacattttcaccaacagtgtaaaagcattcctatctctccacagcttcaccagctctgttctttcttaaatttttaataatcaccattctgactggcgtgagatgcttctcattgtggttctgatttacgtttctcaattgatcagtgatgttgagctttttttcatgcttcttggccatataaatgtcttcttttgagaagtgtctgttcatgtcctttgcccactttttaatggtgttgtttgttttgtttcttgtaaattaatttaagttccttgtaaattttggatattagacccttgtcagatggataaattggaaaaattttctcccattctgtaggttgtctgttcaactgatgatagtctcttttgctgtgcagaagctctttagtttaattagatcccatttgttaattttttcttttgttgtaattgttttggctgctttcatcatgaaatttttgcctatgcctatgtactgaatggcattgcctgcatattgttctaaggttttcacagttttgggctatacctttaaatctttaatctgtcttgagttaatttttgtataaggtgtaaggaggggttcagtttcaattttctacatgtggctagccagttctcccagcaccatttattttacatttatttatttatttagtttttgttttttttctaggtcaagtttttttttattattattattatactttaagttttagggtacatgtgcacaacgtgcaggtttgttacatatgtatacatgtgccatgttggtgtgctgcacccattaactcgtcatttacattaggtatatctcctaatgctatccttcccccttccccctaccccacgacaggccccagtgtgtgatgttccccaccctgtgacccagtgttctcattgttcaattcccacctatgagtgagaacatgcggtgtttggttttctgtacttgcgatagtttgctgagaatgatagtttcccgcttcatccatgtccctacagaggacacgaactcatccttttttatggctgcatagtattccatggtgtatatgtgccacattttcttaatccagtctatcattggtggacatttgggttggttccaagtctttgctattgcgaatagtgctgcaataaacatacgtgtgcatgtgtctttatagcagcatgatttataatcctttggatatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttctttcctgactttttaatgattgccattctaactggtgtgagatggtatctcattgtggttgatttgtatttctctgatggccagtgatgataagcattttttcatgtgttttttggctgcataaatgtcttcttttgagacgtgtctgttcatatccagcaccatttattaaatagggaatcctttcctcattgcttgtttttgtcaggtttgttgaagatcaaatggttgtagatgtgtggtgttatttctgaggcctctgctctgttccattggtctatatatccgttttggtaccagtaccatgctgttttggttactgtagccttgtagtatgatttgaagtcaggtagcatgatgcctccagctttgttcttgcccagaattgtcttggctatgcgggctcttttttggttccatgtgaagtttaaagtagtttttttccaattctgtgaagaatgccaatggtagtttaatgggagggaataacatcgaatgtataaattattttgggctgtatggccattttcataatattgattatacctatcattgaacatggaatgtttttccatttgtctgtgtcctatcttatttccttgagccatggtttgtagttttccttgaagaggtccttcacctcccttgttagctgtattcctaggtattttactccttttgtagcaattgtgaatgggagttcatttatgattttgctctctgcttgtctattattagtgtataggaaagtttatgatttttgctcattgattttgtatcctgagactttggtgaagttgcttatgagcttaagaagtttttagactgagacagttggggttttctagatataggatcatgtcatctgcaaatagagacagtttgacttcctctcttcctacctgaataccctttattttttctcttgcctgattgccctggccagaacttcaaatactatgttaaatagtagttgtgaaacaggacatccttgtcttgtgctgatttgcaagaggagtgtttccagcttttgccctttcaatatgatattggctgtgggtttgtaataaatggctcttatttttttgaggtatgttccttcaatacctagtttattgagaatttttaacatgaagcgatgttgaattttatcaaaggccttttctgcatctattgagaatcatgtggtttttatatttagttctgtttatgtgatgaattacatttattgatttgcatatgttgaactagccttgtatcccagggatgaagtgacttgatcatggtggataagctttttgatatgttgctggatccagtttgccagtattttgttgaggatttttgcattgatgtttgtcaggcattgatattggcctgaaatattctttgtggtatctctgccaggttttggtatcaggatgatgctggctgcataagatgaattaaagagaagtccctctttttcaattgtttgcaatagtttcagaagaagtggcaccagctcctctttgtacttctggtagaattcagctgtaaatacatctgatcctgggcttttttttttttttttttttttttgtggtttgtaggctattaattagtgtctcaatttcagaacttgttattggactattcaaggattcaacttcttcctcgttcagtcttgggagggtgtatgtgtccagtaatttgtccatttcttatagattttatagtttatttgcataggggtatttatagcattctctgatgattgtttgtatttctttagggtctgtggtgatatcccctttatcattttttattgtgtctatatgattcttttttcttctttattagtccagctagtggtctattttattaattttttcaaaaacaaactggattcattgattttttgaagggttttttgggtccctttctccttcagttctgctctgatcttggttatttcttgtcttctgccagttttggggtttgtttactgttggttctctaattcttttagttgtgattttaggatattgatttgagctctttctagctttttgatgtggacattttagtgctacaaattttcctcttaacactgctttagctgcatcccagtgattttgatacattgtctctttgttctcattggtttcaaagaacttcttgatgtatgccttaatttcattatttacccaggagtcattcaggagcaggttgttcaattttcatgtagttgtgtgcttttgagtgagtttcttgatcctaagttctaatttgatggcactgtggtctgagagactggttgttatgatttcagttcttttgcatttgctgaggattattttacttccaattatgggatcaattttagagtaagtgccatgtagcactcagaagaatttatattctgttgttttggggtggagagttctgtaggtatctatcaggtacacttgctgcagaactgagttcaagtcccgtatatccctgttaattttcaattgtgatgatctgtcttatattgacagtggggtgttgaagtctcacactgttactatgtgggaatctaagtctctttgtaggtctctaagaacatgttttatgaatctgggttcttctgtattgggtacatatatatttctgatagctagctcttcttgttgaattgaaccctttagcattatgcaatgcccttctttgtcttttttgatctgtgttggtttaaagtctgttttgtcagaaaactaggattgcaacccttgctatattctgctttccatttgcttgttaaattttcccccatccctttcttttgtgtctttgtacgtgagatgggtttcttgaatgcagcacactgatgggtcttgactctatccagcttgccattctctgtcttttgatcagggcatttagcatgtttacatttaaggttaatattattatgtttgatttgtgtgtccttggtctttgttcttcagtgtgtttttgtaatggctgttaacgatttttcccttccatatttagcccttcctacaatagctcttacaaggcaggcatgatggtgacgaattccctcagcatttacttttctgaaaaagatgttatttctcctttgcttttgaaacttagtttggccagatgtgaaattctgggttggaaattcttttctttaagaatgggagaaaatttttacaatctacccatctgacaaagggctaatgtccagaatctataaaaaacttaaataaatttacaagaaaaaatcaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacaatgttggtgggactgtaaactaattcaaccattgtggaagacagtgtggtgattcctcaaggatctagaactagaaataccatttgacccagccatcccattactgggtatatatccaaaggattataaatcatgctgctataaagacacatgcacacgtatgtttattatggcactattcacaatagcaaagacttggaaccaacccaaatgtccaccaatgatagactggattaagacaatgtggcacatatacaccatggaatactatgcagctataaaaaaggatgagttcatgtcctttgtagggacatggatgaagctggaaaccatcattctcagcaaactatcgcaaggacagaaaaccaaacaccacatgttctcactcataggtgggaattgaacaatgagaacacttggacacagggtggggaacatcacacaccagggtctgttgtggggtgggggtaagggggaaggatagcattaggagatatacctaatgtaaatgacgagttaatgggtgcagcacaccaacatggcacatgtatacatatgtaacaaacctgcacgttgtacacatgtaccctagaacttaaagtataaaaaaaaagaaaagaatgttgaatattggccctcaatctcttctggaatatagggtttctgctgagaggtccactgttagtctgacaggcttccctttataggtgacctgacctttttctctggctgcctttaacattttttccttcatttcaaccttggagaatctgatgattatgtgtcttggggttgatcttctcatggagtatcttactggggttctctggatttcctgaatttgaatgttcacctgtcttggtaggttgaaaaagttctcctggatgatatcctgacgtatgttttacaacttggtttcattctgcctgtctctttcagctacccctatcagtcataggttcagtctttttacataatctcatagttcttggaggttttgttcattccttttcattctttttttttcctaatcttctcttcctgttttatttcagcaagatagtcttcaagctctgaaattctttcctctgcttgatctcttcagttattgatacttgtatttgcattgtgaagttattgtgttgtgtttttcagctccatccggtcatttatgttcctctctaaactggttattctgtttaacagctccttctgaagactacttccgtcagtttatccatctcagcctctgcctagttctgtgctcttgctggagaggtgctgcaatcatttggaggagaagaggcactctggctttttgagttttcaacattttttcattgattctttctcatcttcaggagtttatccagctttgatcacagaagctgctgacctttggatgggtttttttgtggggacttttttgttgacgttattgttattgttgctttctgtttgtttatttttcttttaagagtcaggctcttctttcataggcgtgctgcagtttgcttggggtccactccagactctatttacctggttcctttccacacctggaagtgtcaccagtggaggctatagaacagtaaagatggctgccttttctttcctctgggatctctgtaccagaggggcactgacctgatgccaacagaaatgctactgtataatgtgtctggcaaccctaattgagggttctcctccagtcaggaggcaccggatgtgggactcactaactgaggcatgttggctgctccttggtggaggaggtgcactgtgctgggaggaatcccacttgtctagactgcccagattcctcaaagccagcaggggcaaagactaagtctactgatttgcgaagactgcggccacccctccttctaggggctcagtcccagagagattagagttctgttgctaaaaccctggctggagtttctgaaattcttgtagggagggcttgcctagggaaatggtgtgggtaaggatccagcctaaagaggcaatctggccacactctgccacagccacggtgctgcactatggggaattcctccagggtccaaaccatccattttccctggcattgcaggggaaagatggcaaactggagctgcagtgatggcggccacccctcctcccggaactcagtcatcttatgcagcaggcagccacagtgatggctgccgcccttccccttgaaagctcagccatcttaggcagcatgcagccacagtgatgatggccacccctccctctgggaactcggtagtcttaggcagtctccagccgagtagccgctgagaatctgcacaactctgcggttcagacccaaggctctggtggcgtgggctgacaagggggatctcctgatctatgggttgcacagatctgtggaaaaagtgtggtttcccaggcagagtagcaccatcactcaccgcctccctcggctgaaggtggtagctccccttgccctgtctgactcctaggtgggctgtggcaccactctgcttttccttactctccgtaggtcacaccaaccacctactcagtcccattaagaagacctggatacctcagttcagtctgtttaaataattcttcaagtttgcaggcaactgaaactcaccagttaatgattaagtagtagccgcacctgttccatttgataagaaaggttatttggagaggatcttagctctagaagcccaatggggagggaagcttgtggttaagttattggaggccctgtgatttcaccagatatccagtcagcacataattttagacattagttcttaggctttatatcatataataaatatggctggaatgatagactagaaaactcttgatgtttctgtcctaatattataatttattaatgaaagaattatcaatacattctaaaatcattgggcaaaaagtgtttaagaatagaatattcatgttttcaaagcatcattgcacatattacttgaaaggtggaacatgtccctttaaaatggaaagatcatacagtgacaatcttaaccaagtggctaagtttggcattactgatggtgtaaagcctaactttttgtttcttctgatgacatgcaatgggagattcactacaccagttttgtggtattcttaccaaaaatgttgacctcagtctaatcgcaaaaaaaaaaaaacaaaaaacagacaaatctatgatggtatgctttgcgagacagctaccctgggcttctcaaaaagttaatactttaatattaaatcaaaatatgtaataatgaataataggggaaaacatcaactattttaaattagataagactaaagtaacgtaacagtgaaatgcaatgcatgaagttgcatgacagaccgaaaagatataaagaacatttacgtgactattgatgaaatgtaacgtaggttgcatgttgtataattttattaaactgtttatttttctcaggtgtggtaatggtgttgtggttatatattcttgggaggcccatacttaaatataattgtgcaatctcctttggatcattcaacaaaacagttgtgtgtatgtttatgttaaaagagagaaggagacagagagagagaaaaggagagagacagaaaaagagagagagtgagagaaggagagaaggagaaaaagtgagagaaatgaagtatatatggaaagatgttgagaattagtgattctaagtgaggattatgcagatctttattgtactgttctttcaacttttcttcaagtttgaggtttttaaaagtaaaaaaaaaaattaccacatagctgaaggtgaaaacataccaattatggtggataaataacttaaacagggagtcagacttctgctcacatcccttatcataataaaattgcagaatctaagaggaagtggaatcttaagagattttagaagaaaggcagtctacagaagacaagcaatttaaacaggcctctcagcaacagccattagaaacctaaatacaatggaatgtaacttcagtgagctgaaatagcttaaaattctgtacctagccaatacacttttcctgagggtaaaatatatgtttgaacagataatctgggataagccaaaaacaaatactcagtaaaataaatgttaaaggtataatgtaaacagaaaaaaaaatccagatgtgaaagtaatgatacaaaaagaaattatgagcaattatattggcaaaaatgtgactaaatcaaagcaaattatgactatataaagccaaagtaatttgaaattttgtgaagaggaaaaatatctttcaaaaaactgattaaaaaattatatacacaataggaaggggagtaaagtaactgtatactatggcttttgagtagtttgaagaggggtaagttaattgtttttaaattagcataatcacaaaaaatatagatgcaaagtacaaatttctaaaaatagaggagaaaaatagaataagaaaataggaggcacagaattgagactccaagaatatgaaaaatacaatccaggtgatagagtaagattgggcaacagtgacagaataaagattgaggaataggtaaaccaatgaaatatattgttaggagagcatttccaagaccacaaagaaacttagcagctctcaattataaataaaagttattttatgataatactaaaactcttattgaatttatgagtgagccccgaaatagaacatgtttcataggcataagacttgattaaatcactattttctctaggagggaggcccctgtgacctggggggaagcctacacacagctctcactgatggacaagaacagtggccatcccagtcaaactaaacttgtgtgaagaaaaattaagcctagacatcaccagtctgtgacctctagtaccacccttgtacctgtatcacattctactggtataactcaaatataagttcagagtgaaagcactgaatcatgaaactaagagggtaacctgtagaagaagagccagagatctgattgcatgttaggcttcactctagactgtagcctctgaggattaataaaatctttggaatgcaaagatcacttttcctctgaataagatttgtgaaatctctagaattatgcactttcatatacatctgtggttctgcctaattttaatgggtactgccttctgattctgtgggaagaaaatatcatgggactttgaaatccgtcagttgattgcacatttcttgttcagtcaaaatttacttagaattccaagtgtgcatttactaaaactgtgcttgaagggttggtagtgggtgattttaattctctagtattatatgtgattgcagtctggaaggctgaactattttggtgatggccaaccatgcagtaagaaggttaacacaatttgcaatggtaatctctctttcatctacacatttcagtcaaccttggcattatctctaaggccgaatccaagtgcctgtaagccagaagccttcaggaaagagcagctgtttttgtgctctctcacatcttgaattctaggtcaaaatgtcatgtaaaagttttttcactaaaatatctatattgatttctaggaataaaatagaaatgcctggaggattctgtgtattttccctgtaagtcactgaaatatcctggtaggccatcaagaaataaaatggattttgtctccattgtatgattgagtcctcccttgaaatccttgctattatctggaccaacaaatgtgtagagtccagactaagagtggagttgattcagtgtatgtatccatgggattttggtcaacaaaacaggactacttaaagccttgttgggtaggggtttattataggaatcagaccttacacaaacacggaagcactaactgaagagaaagtgtttaagggggactgggatgatcagagaaagaatcactggctggttttcctgaagcgctgactcaggtagacaagaagccaagcatgctctactgccaaagtaggactctgaagggggcacttcagcaaggtctgtaggaagatgttgtctttggtggccactaccactgtgagtccacagccaaatgcccagtggtaggtttggggccaccattagtcagcagggccagctactgaaaaggtggactagattcagagaagaggagaataaggatacactgagtcttgctgggtacccctctacgtatcttaggcatctatcttatgaaaaccttctgaaagtagtagcttctgtttctcttcttccttccatatctcactgaacgtctctcttctggccaattctaatgtagaaatatcaggaaagggtattgggaaatgtaatactccatatttgcctgacataagcaagataatctagttagaagctggcaatttccttataacctaggacaattaggaagtagaaattagagtctaaagcagtctgcaaactaggaagacagtggcaaacaggagtaacaggaaacgaagtcaggtgcagtagacaaacatctgtcctggtgttataggttgtgccagtatatgggaggctgagggtcagaaggtttatgcaaagaaccaaagcgaagcaagatttacctctgaaatgacaggaggtcacaggtacatgaaactcaaatgcattacaggtttttttttttctttgttatccaaatataaagagcaggagataaatttcatcaccttttgaggtgtttgttaaaacatgtagatttctgaaacctccttgcagacctaggaaccggaatctctagggttttgattcaggaatctgcattttaaatacaatcctcagatggttcttctgtgcagtctagttgggaaatatatgattcgcagagtgacagattcatgctaacgtcatgtcaggtacttactgatctgcttcagcactgagaacagagactgaattagaggaccagatatataagtgatttttttttaactgactcatacagtagattttttttttttttttagagaagataaaattcaggctggagatggcaaataaattattcatgtcacctacctagtaagtgactgggcctatactctaatttagatctacttgactccaaagtgtaccctttgagtgttgaatggagtaaaaggcttcaggcttgcagaattactgacttgcttgctaaacattcatcagtgagacccctcagggaaggaaaagtaatactggtctcctattaaactaagtctgtgtggatttctaagaaaagtcctggaggccaacattcccccaaataaaagaactagtaatggaggaaggcaggtcctgaaaaaatcactcccaagaaaaatgagaacttcacactcgctttgttttctgccccctcctcctccctctctgtggacccagcacttacaactactatgacctcttccatctttatgtgtcttcatcataccaagtattcccctttcttatctgaaaaagaaaaaaaaagaagaaaggaaaaaaaaaaacgacatcttgatctcgtttatatggaattaattttacagttaataagtaaaacctaatattttttgtctacttttttgggagcaatatggtgaactcatattggcaaagttatttaatggttttatgaaggaatagataagtgtgagtgagaaagtgtggaatcagatcgcagctgtaaagataagctgaactatggcagcgcaatgtgacccctagtccttgcattctaatttaggttctgctgggaagctttacgagattattgaatacctttctagcaattagagctggcctggatggttccggttgccttgggaatttggaaattcttctatgtgaaagatgtttctgcaggagctgatcattatacaccgatgttacaaacaattaatttataaagtacaaagtttcaatttcacagtgtttattttgtttttttctgttagctatctgttcaccagataactatcattctttccatatcttgtggaattcctgctaggactaataagataggaactggaaaatagctttgaaaatagaataattactttgaaaatagaataatatgtattatatgatatacatacaggaaagtactcctgcaacagcaacaattgtactgattctaatatcccaaatccagcggctgctcttcaccctctctcctagcccaagccatcatttctaccagtttactaccacagtctcttaaatgatctgcctgtgttctgtctgcttccacaagagtccatcgtctactcaaagttgttcagatcctgtcatttccttgccataagaggagaatcaggacaagttttgccacggcatcaaggccccgcgtgatttgtcctcacctgttttcccagtgtcatctcctcacagtcttccttggttatctgcatttcagcatcacagacttgctttctagtccccaaatgtgcccacctcatttccatctttgtctctgctcttcccgttcatttccaatactacctcttcagagagacctctttaaaccagcctacataaatgaaccccactctctccctctatcctagtatcctgtttagtctttttattaccgtacttatcactgtctgaagttatctacttatgagtctctatgtgtattattagttttctgctattataccgaagtgcaagctcaataagggtaacgtctttgtcttatatcctcagttcctagaagaatgcctgtcagatactgggttcaatgtgcatgtggaataaatgaatggataaatggaaggaattcaattatatttgacatttggtaggcagccagattcagtgaaattatggaatactggtgcctcaaaacaaaaccttttcttatgtcatttcatatacgatagtgttaccaagtatcaaccttttcagccacacagcctgaaataatgaaatggaacatagtagttggacttggaaccaacttctgccttaagcagaaagctcatgcagaatttaaagcgattattaaggaaagaaaatcctcttcaacacccacagaaagatagggcattgcttttcaagtcataagattttcagtaattagataggagaattataaatatattatttgcatgttacacattcctgtaactctaaccatccaaatatggtttctatattcaaaataggtagcaatttaaatataaatgagacaatgcctcatacatacaatataatatttaacttaaaacaccgagatggttaattccgtgtgtcagttttgctagctacagtgcccagatatttggtcaaacattcctctggatgtctctgtgacagtgcttttttggatgagattaacattcaaatcagtggactttgaataaagaagattaccctcccacaaggtgggtgggctcatccattagtttaaggtcttatcagaaaaaaattgaccttccttaagcaagaaggaatgctgccagccaactacctttgtacttgaactgcaattcttttccgcgtctccagcctgctaatctgtgccattagattttggactctgcagtctccagggacaatagcatggcacagtccctaaaataaatttcccaatcttcctctctctccttctcttcttatttctcttaaattccctttctctttcaatctctctatctccctctctcctttccctatctctctatctctctctctccctctcagtatctcatacacacatacgtacaaatatatgtgtgtttacatatatgcatatgcattatatatatatttatacacacacatcttgtcctgtttctctggagcattctgatacagacacatttctgattatagatttaatatatactatattgtagtttaaacatatagatatatagagagagatttaaaatatactatgttgtagttcaaaatatactattgaaaaaatttacataacctgtccaaatgtttatttggctattaattcaattaaacagattgacctcatctatcatttctgatagattacttctaagaaacagaagatggtaagtaatatctcatgcattatgaagtcatttaaattatttaacatgcattaaaggagaaattcaatgtagctcatttcttcaggtttactaattaaagtcagtcttgactctagaaataaaaaaaaaaatgcgtaagaagagcaactgtgacagcattaatattcagtgaaattgatgaccttagtgggttagttttatataaactgttacggtacgtacaacttgtcactgtagttcaaagttatgttcaacacaatggttcttcttaattgctcaagacactccactgtgacattggctacttcggctgcaatagagagattaaagaatcaagtcattgtattttacagttaacaggattgctaataaagaatagtagcagcatgaaaaattgtagagaggcagtaaaactgaaagctcaagggtctacctgtatagactgcgaaatccatatactgcaccaagattacaaatggtgattaaagaggagcccacgatataatagattaaaacaaaaggttaggtgtctaacagaacactggatgattctgggaggatggggcacataagacgttataaaaacagagttatattccaaggccctttttaaattacaagaattacttgtacttttactggcattagtttttgcctgcaaatgttgctagattcatcatacttttagaaagctgattacaaggttttggtctgttcccatgaaattccatccccagattttgtgacagtagcccttcatttagcaaaaactcatgagtttcttctctgtaccagttgctgatgagcttagtcagttattttttatgctgtcactgtttagggcaaatcaaaccattgtctaaacagttcactttggaatattgtgaaaaaaataaagtagagatccacttaaaaatgttgaatgtggttcttgtctttatctttgttggtactttcctgtcattgccataatcattggctccattagcacctgactggccaatcaggtcagttgactttgttcatctgagccactgaacatttctaaatccagtctcatactgcacatcaactgtggttccccatttgtaaattaaaaaaacttaaccatgtctaacccacaggaaaataatagtttctttttttaaatatatatatatttttattatactttaagttctagggtacatgtgcacaacgtgcaggtttgttacgtatgtatacatgtgccatgttggtgtgctgcacccattaacttgtcatttacgttaggtatatctcctaatgctatccctcccccctccgcccactccgcaacaggccccggtgtgtgatgttccccttcttgtgtccaagtgttctcattgttcaattcccacctatgagtgagaacatgcggtgtttggttttttgtccttgcgatagtttgctgagaatgatggtaataatagtttcttagtttacttgttcactgaaggactggatgcaatggctcatacctataaacccaacactttggaaggccaagatgggaggattacttgaggctaggagttccagaccagcctgggcagcgtagagacactccgtctctataaggtatttgaaaaaaaaaaaaaatagctaggcatggtggcgtgcaccacctgtagtcctagctacttgggaggctgaggcaggaggatcccttgagcccaggagtttggggctgcagcaagctatgattgagccactgcactccagccaaggtgacagagtgagaccttgtctctaaaaataaaaatttaaaaagttattaattgaataggagtttggtgtgggtggagttaacagtcagtaccactaatctccatattttaatgtggtttatataaactataccaccaaagatataattatttatattgaaatatcagcatgcctaacaacataattggattctatgtttatttgcaatatgagtaagtcagaggaaaactgatagagtaggaaagtcagatttcaaaggtgaactgtataggaacttgccctttggtcttacagtgctgtctcctattattttaagcattcaccttaatgataccatgaaaagtattctcaaatgggatcatataggaagccaagacacagactgttttagcttaaagggccctgagaattgagattgttttgaattcctaaacactttccttatgttataggccaagcccaagtcccaaatgtgctttactctgttccactgagttttaaaactttgtatcagttaccaacattgaatattgagagttttgatatagagatagtaattttcaatttatttagaagattagaaaatgtggtacacatccctgcatgactatgataagctggagctgagaagctacaccctctttcagatgagtcctgtgatactcagggcttcccaatccccaccagccactttattttttacatcacctgcctagaaactatatcaaatgacttctcagtcccttagtctgaatccttcatttttcccatgtaataatttgagttatgaatagaaatagtaatttgcctgaaattgaggaaaatgaaactcccccttactaagccatcatgttatatccccttcttccttattataaaaaaaattatgctgttcagggtggatgcacgtttaagtcaaaatatagaaagtaaacaaaaccattaagttcttaggcacatttgcaaaaatgactcattatataacatgctatgttccaatattaaaaagcagaaatcagttggggatttctgggaaatgtttgctctacttcctctttttattccaactctatttccttctctgtcttcctatataaaacattaagatgaagctgaagcatttatatcatgatgacgaggtaacaattattgggacaaagcacaacataaatatcatagacaggaaagacagaagagtctaaatatcataaggcgttatgttttgttttttgttaaatatgatcctgactgacataatcctgactgatacacatatatatttcacttcccatcacacacacacacgcacatgcacatacacatgcacacacatgcacgtgcgtgcgcgcacacacacacacacacttctttgccctctttgcctcctcctatttattattttattcaacagagagtgactagtgcttactctatgtcaccatattactgcactggccctgcttctacctggcagtgatggagatcagactgtcacatattgcttctaaacttagtaggctcatagaaattaaaaatagcatgttctacctagagctttaaagatcattacagtggggctattagcactgtgaatgggaacacagcctgactctgggtaaaaaaaaagaaattgaagagattatatatgggagattctataattactttaacaaaattaagagataaggcaacaaagatctaatactgtaagtcccacctgcattatttgtgctgaaacaccatgtctgtacattggctgtgacatgtaataccactgaaacacagggtgtttagcaaacatttagttatttccttaagccacctgggctaacaggcaagggattcctacgtagatggctatactgaaagattttgacaccatttaaaaacattcttaggacttttgagtgaattatgttttcagattatttagtttgggcaggttaaacagactgtttttatacaaattctaaaaaagttgacaaccctgagcctcaatttccttctctttaaattgatgattttgatgattctgaattgtaccactattaagttcctgctagatctaccatgtttagaagtctgtaacgtcactctctaacgctgtttatttttttcttctttgcccctgtgtgcacactgctagctcttctattaatctcagcagatgagggaggtaatttcgtttgaggtcaccaaaactgtaggctataaataggaagtaagatagtcattctatagtaaccataaaaatagttctcatcacattgggatgaaacaaaagtcatgtcacctcactctggagacaagagatttatctagttatttgtaattcctatgggctccagatgcatggacagaaagaaggaagatggaaacatggaaggttaaagacacatcagggcctatcctttgcttagtgtgacacaatcaaaggaagaagaccggctccctttgggtttaaccgctttatcaagtgccgctctatacattacccagagaaatgccttctgaattctagaatttcaggcattgcagtaggcagttgaagttgtggcagcagcacataggaagctttttaaacctctccatgcagctctacgatgattatactcattcattagcctttttcaacaaacaatggtttagcagctggtatgtactaaacactctgctaggccttcaaatatggcattgcacaaggcaagatctttgctatgaaaagtgcaaatgtttaaacaataacaaggtagatgttgtattagaaatagtacatggtaaaaaaaaaattaacaaacaaaggactgggtaacatgactgagggtacatcttagtctgtttgtacactacaacaaaatacctgatactgggtaatttatataaaacagaaattaatttttcacagttctgggggctgggaagtccaagatcaaggcactgtcatgtgatctgatgagggctttttttgctgagtcctcacatggtaggaagagaaagggcaactagggcaagcctccctaacactgagtgaagccccttttaaaagggccttaattccattcatgaggcaacagctctcattgcttaagcatttcttaaaggcttcccttcttaatgctaccgcattgaaaacacatgaattttggaggtgatttacgttcatcgtgaattttggagggagcaaacacattcaaaccatagaaggatgtgactaatgcagtaaagattcatatcacttttattctgtgcaaagaaggaaaaacttattttatgttgttactttagtttgcatgtctgagagagggcaagtgatccctcacatctagcttactaagatttattcacttaaggtaccagaagaattctccaccagagcaaaaaaaaaatagtgagaacctaagaattccttcatttagaattaatcctctatatgggaaatatatgtttttaaaaactgaactcatagaagcagagtagaatcgtagttaccagggtctgtttagggtcagggtgggggcattggtgcgatgttggtcaaaggatacaacattatagttaaataggaggagtaagttcaagagatctgttgtacaacatggtgacgatagttcatatcaatgtatgatattcttgaaaatccctaagagagcagattttaagtgttctcaacacaaaaatatatgtgatataatgcatatattaattggctcaatttggcccttccaaaatgaatacgtatttcaaataatcatctcttacccaggtgatgggttcttaggtgcagcaaaccaccatggcacatgtttacccatgtaacaaacctgcaaatcctgcacatgtaccccggaacttaaaaaaaaaaaaaagaaacattaaaaagtagacaatttttgtcaattgaaaaaatttaataaaacttagcctagggtattctaggtaatttacatagattatcccaagggaggaaggataggtagtgtgaacctcttaaagcaaaggtggagtgaagtgagagttcagattagtggcgtggagagtccaacccagttggaaagcaaagcagtaataggagtcatatggaggattctcaatattcacctttgttgccttaacacctagcaggggtagaaggagccaagacttaatagattaatggagtagggacaccaacccagttggaaagcaaagcagtaataaagaccaggtggcaggactggcacaggtgagtactggaaacaaactgagtgagtccacattactttcattatcctctttaaaatgtgtctttccagcatttctgggaagagaaaaacaaaaccagagaaaattcatgcttctagggaaaaggagaggaaatagatagtgcaatagcaagaatgagagtattaatgacaggaagtaatgtaatcctaaagggattagtgaactaatgcttataaatggctcaagtgcctgggccaaatgttctatgtgagaggagctactcttctgttactttctctgagctcattaacaaccaaatggattataatgggcttcaacaggattaagtgacaatcaacaatcaaagtaagacaagagtttattatgaagaatattgtgttcaaagattaacattaaactcgtgaaatatattgtagaaacttcagattacattttgctatgattttctttttatatgtcagtcttcattcctccttcagaatgctctttttatgatgatttgtacataattatttttaggaacccattgatcaatgtcctagtaatatttcattcttttatatcatcttttacaataaaattaagttgctttcagactaatttaaaaataatctttggggttaatgttttgtttccaaattatgaaaaaggaaggaattcaatcaaatattgcattctattaccaagtggattttaagtaccatatgctgtgttttatgccctatattatgtagtcagaatgaaaatgtgctccatgttttcagaatatgtactaccttcatctttcacattatttcaaatagtgagaaaataaatatacatccattcttcctcctactttctttccttatatttatctcccaactagccaccagacattctctctacatttaatacctacaaagagggctggctgctattcaggtcatctggcaagtatcatgttttctccagtatggaaaaactaagacatatgtgttttgtttacagtgtgccaaatgtgccaattcaatgagtttttggatttgttggcaaaaaaaaagagagagactgaaaaatagggaacagcattttttcctgtggccagtggtcatttgttggcacaaggaatttctgtattataaatgacactcaattctctctttgatggcctcactttgagaacagattttgaataaacagatcttaggcacacagaatttcaatcgtcgaggtgtatctgcagaagtaattagatacttgcaagtgacttttaatcacttcaacttgaatccatgtgttgcaaaaagatgtactagctaatgtgattattccaggaacatctaaaagttttcactgagtaacttttttttgacatgacaacttcttatcgtctcgatcttgaagcattggcatccagataaaggcacatgctggcatggggaaagggggggggggataatccacttgacaactggtaaagataatcatatttttataatttttgataaataaattaacttacaagccttattatgactctagtttcttctccctttaatcagttacatctattactgccagagtaattgttctatttcatatattttgtcatataatccacctcctaagaaagactgttattgtttacagattatttctcttcttaggatgacacacaggtcctttcacatgtggtctctacttggtctcccagactcagctagcctccatgagtatttcctagtgtagccatattcaacacactccctgctccctgaggtgcccatgcatttttgcccatggtctttgtcttccagtagcattgaaggagaaagaggaggaggaggagcggaaaaggagtggggagggatgaaaagaggaggcccagagaagaaatgagaggaaagaaatgtccaacgaagggaagagaaagaaaggaagaaagagagtgagagacagaatttctccacatttctcaagactcacctcaagtgatctctcctcttcaagccttccctaaatcccctgacagagagccccatgccaccataccttatgctgtgtcaccctctagcaaatttacatggtataacaaagcatgcttatctttttctccattatagattatcagaaacttgagagaagggtctgagtcttgctgtctctgtgtttcccatcacctagtagtaactagtccaaaactatttttttgaaagaaggaatgaatgaaacctgcaaattaattaaaagcgagagaacaaacaaaataaaatagatttgttcaactctgtttgtataatatgaatagacttctaaattagtctttctagttggtaaattggaggaaaattaatgaacctgaaaaaatgaaaagtaggtgtcacattataagctttctgagaaaatgacttgaaccttttatccttgtgttatcctcctttcccggcgctgaattatcttctaaaatggtttgctcaagtagaaagttaattaatttttattaagcaattagaagaaggaaagcaattttcattttcaagtaaaagaattcgaaagaaacagaggagatgactaatcattaggaatggcttagacgccgaatggtttcccacatataccaagataaaaagaatgcgcaggaggaggatgatccatggagtaatataatactgtcagtcagggtacagacaggaatgtctgccctgtcagctttgatcataccatatggggactggaaaaggaaaagatggtgcttttttacacatattctctagcttccgtttatactgaaaagttattgtaaagagaataagcagatagtttccatggttggacagcctttgtaagttttgcagatttttattgtttttaccaacagtgacatgcttaattcttcaagttgccacactcaactgaattgaattttagtgttctgttaactataaaatataatgattcatttttcaaagtttccctgaagcacatcagttcaatgacatctgtaggttaagaggatgccttatgattcagatatatgagaattcgaattcagactctataattgaccttatctgtgatgttggacaaattaaattttatctttaaagactgtttttctcagatataatatagaggtgaataacaaaaatttaaaaatagctggaatagttggatacatgatatatgccagacattctttcaagtactttatagaaatcaattcatttaattataccaataagtttatggtttaagtacaatgattgcacccattttacagaggacagaagtgagaactagtaaattatgaattatttggtaaatgaagtgtatagcacagtgtcttgtgtacagtaggcagtcactagctggaaacagatattgcttatttcttcatgtattagtctggattctccagagaaagaaaaccaataggatatatatgtgtgtgtgtgtgtgtgtgtgtgtgtgtgtgtattcctttaatatatgtattctctaatacctttatatattatatatataatgtagatagatataggaattagcatatgaagttatagaggcggagaagtttcaggatctgtagttggcaagctggagactcaggagagccgatggtacagttctagtgtgagtctaaagtcctgagaaccaggaaagacaatgatttaagtttatagactgagtgcaaatatgacagcaggggaagactgatgtaccatttcgagaacagttgggcagagaaagcgaatcatctcttattctgcattttgtttgattcaagcctccatggattggatgaggcccactcacactggggagggctgtctgtattactcagtctgttgattcaaatgctagtctcattcagatacaccctgaaagatgcactcagacataatgcttaaccacgtgactggacaccctgtggtccagtcaagctgacatgtaaaactaaccatcacaattcattatggcaatttcaaagaaggaaaacattggcgaaattgtttacaaatgaattctcaaaataaatgttctaattatattttacagagacacagggggaaagcacaaatgatgatggagtctggtttatacttcacacacagaaaacattcattcaatgaataattgagatcatcagttaattagaggtggatatacaaaatttaaaatattgtgacaggtaattgaaaagacaaagtataagaagcattaaaatgagaagacaatttaggaaaagtaaagccggggatatgagggcaaagaatgtaaaatcagacaaatagacaaaacatacattaaaatttgtttaatacaagttaaaaaagaataaaaaattattcttagagtaataaatgatgactgcacagaagaaatatctaacgctagcattttatattttacccaatttcaatccattctcagtagcaccagtagttcacttttaaaacaacaaatctgccatctacattaaaaatgtcttagataatctccgctgtctaaatgaaatcctaattcctttgtactttatttaatgctcctaaaagtttttcttactcttcatttgcagcctcatttctggacacagttttcccaatatacaataaattctatccacaatcaacttctcataattttccggaaacacaatgtgtatgttctttctttctttatatttcttgtcttttctagatgattccattcccctttttccaactagtgaatcctcttccctagaaggcaagttgatgttgatgtgataataaaaggaatgataatgtcatgggaaagaagaggagaatgttggggattatagctctcttttattagttattttggccaatccctgtagaggatatcttaactgagtattttatttaattcttacagcaaacctcctttttgttatccatgttttattgttgtgaatgctatagcttaaagagattaaatgacttatccaaggtcacccagttaataagactattttactcagttcaaataccaaactgactttcctaagaactcttttattaagaataaaaattttaaaattcgtaaagccctacaacgttctttttatattgtatctaattatatcagaaatatttacacatcagtctactcaatttgattttgattttcttgaatctaggaatgagtttcatccaccctgcttcccccatcccctgcagtgttagcttcatcacaagcagtttataatcttttatttaacataaacaaatataaaaaataaattctaagtatacacgagtgaaggcaacatactcaatagtacaaacaagaaatcaaagcgaattgcctttgtcatttaaaaaatttggaggaattaaaccttattaaaattccattaataacgttttctattaataattcccttattaaaatactggaatgtcaatagatacaggtattgaataaaactaagcacataatttaatgatttttcctaattattattcagggaatgtctttgaaaagagaagtgcaaaatatacaaaaacagaaagatcaagaagcatgccaaattggcattgtgattgccaaagcaaacagaacagtctgtaaattattatttagggattggggtggctcttgcatcagtcacaaaaagtgtggaaattaaataatatgctttaagaaatcttgtcataagagaacacagcatacttcttcctacatctatttttaaatgaatttcttatatgattgctcatgaagaggaccaatagtagtctttattgtttataaaccaatcaatatctctcagtctcaatgtgtaacctctctgtcaccattaagacagcagacggcaaaggaggggcaataaattttagcatgtaacagatgaagtagctgatagggtcattagagtaactatcagggatagagaaagctgtctcccaatatcagttcccacaactttgacttttaggttgcatttcttcataaaattcagcctgatttttctaatttccaaaattctacacttattttctattttatcttgtctctttttggatgcttttaaaaattattcctctaagtgtatacttggaaaaaaaattaatgtttctttgcaacttcaccctttgattgttatatatgcattcaactggagatgaagttgggttgaaatctggaattcaagattattttataccaaagtatatattgttttcaggtaatttttataatgtcccaaatacgtaactttttaggctttatttaattatagatatttggccgaataagcacaatcgaaagtttcaattaagagtctaggacacaaagtttggggaaaaaaaatcatagtattctaataatatgtattgctttgatgctgtatgtctaaaagcactcatgaatacctagtgcacatgtgtcaaaataaaacttttttttagagtataacaagttctttagaaaactttttgcatcaaatggtgtaaaaatgaaatcattttatataaatttagaatctgtaaaaggtacaaattatgctttgctcatcaattgtatttatttacatctaatcaaccccatcttctgtttcctactcaatattagctctattatttgattggtttggatatataggggcgtgttatcaaattatacgcacccttgtccttttcctcctttcataagtttccttcaaatttataattcttattacttatttaaatgaataatgatggagaattaataaatagaataaatataaaaagatattaatcatataatcgctcaacacattcctactgaattgattttaatttttgaagaattatcatattatattgaataaagaattagctctcaaataaatacaaataatttcttaggggaaggctgaggaggaagactgaatgagaaggagctttggcaattgggtgttaaataccatgggaaatagtcaaactcatagtagataagaatagaatgaatgatggttgccagggactgcgtgaggagaaaatggaaaattatttttcaatgggtataaagtttctgttatgcataataaataagttctaaatatctgatgtgtaacatagtatctatattaataagacagtattgtgcactttaaaatatgataagagtatacatctcatgttatgttcttaccaaacacacacacacacacacacacacacacacacacacatttattaccttgattttggtgatgatataatgggtatatgcatatttttaaactaatcaaattgtatatatttaatatgtgcagttcatgtgtatcaattatatatcaataaagctaaataatacaatggaaaattcagaataagacagagatggattgtgaaataatgttcatacattgtgttagtttttcttaggctcaaattggtgctaatttttttttattctgagagataaaaagctgaaggtttcagaatatcactaatgttttatatgtagttctgaagatttgtacaaacctctcttccccctttttaactttatataaaaaaggagaaagatcaatctgtcggtatgagaaaggaaaattataagttctatctggggatttactcgtcattaagtttgtatttcaatattgcaaaaaactcttggctatgattagagatattcatattaaaaattcagataatgtagactgttatgaagaagaagtttcaaattagctgaaataagtttcaaagtcagttaatttgttaccagcgggagaaagtcaccattatatttggcgtgtattcctgaagagcatacataagatagacataaacacaactacaatattggaaggtttgcttatttattttatagaaataatcattctgtataaaatttgagaagtgcttctttcttacagtttatcatgaccatttttctattatgatggttgccagggactgcgtgaggagaaaaatggaaaattatttttcaatgggtataaagtttctgttatgcataataaataagttctgaatatctgatgtgtaacatagtatctatattaataagacagtattgtgcactttaaaatcatggtagacatgatttattgtagattatacattttcccatcctaagaaatgcatagtttttgcttccattggcattaaataataattatgtataaggaataaatttaacataaacctcttttatttgcttattcaaatttatttaaaaatttgaatgtttgtacaaacctaaaagtagataaagtgagaagaatagcagccataaattttctcagaaaattacatgaaaacctaattaacagctggtgataacaatggtgaaactaacttcccaagattttaaaatcagtcatttaaaacttacactgtcaaacatcaagttcaatattcattttagtatgcgactctgcaatcgacaaaaatacatttcttttaatttatgaaacagaaaatatggttgttttctctatttcttctcttaagacattatttaatcatctgtatctttcttttattgatctcttccttttaaaatcttcattactcttgtcttttctcccagctagtccacttgctctgctttatcctgttatgatcttcttctaatgctcaaccaccattccaaaagggcttcttcataatttaaattaataatgtgagtgtgtgtagaaaaaaaagcgtagaagttttattttaatgtttttgagcaacctaaatgcgtggaagatgcatcatcacgcaattttaaaaataaaaatgatagattgatatattttaatttgtattacatgctatctgcttatgttcttcacatgttaatggctactgaaaataaaaaccattacaaaattctcttgaagcctttaaacagaagaaacaaccttgtaaaaataaatatttgtctatgtgtctgaagagaaccttcttccacagctgtgtggaagaaccttccacagagcataggtacatgttgcccttttttcaatatttaagatgttatatgtcatatttaaattgttgtagtattccaagacagtaaaactagtgatatatttaatgtgacaataatgtgttaatttttatttcaagacatcttgtatgaactactatttttgggaagaattcacctgccctggattgctatgctctatttggaagtacatatccaaatatcagtcatttatctctattcctaaagtctagtaaatgcaacaagcaatctgaaaaagagaactgcagctgcataaaatgagcataattgattactaattgatatgcatctaatagagacttctttctacccctttagtatctttttatttattttgaataatgttttcatgtttggcccatttccttgttctttctccaccccaatctcccttatttatttaggtcaacttgacaaccccttttttttttgagaatgaattcgatgtcttaaaatctctctctctttttatatttattttagtttggcagcaaacattagttctcgcttgctatattttactcatcaaagtgttaacatcattcataaattattaccaatggtaggcactggttgttatcaatcaccagggaataattgatgctgattgaatcaaataaatgtggtgtttgtgaaactatgaccttgtcattcaacttgggtacaaaaatctattagatctatgagaactgaatcttaaagataactgaagaaggcagctttctattgacttaaacaaataaaaatgtctttttatttgaatatttctttctttacaatacatgatagtctaaagctctgaaaaacaacaataaaatcactactaatctcccttatgtgagactaaatgaagggtcctgggaatattaattctgaaagaaagcttgtccagcctcccattttataataaactatatcaattcaaggactacacagagtaaattttttcaagttgtatagttctctggtttgaaagtgtcccccaaagtttatgtgttggaaacttaatcccgaagcaccagtgttgagaagtgggacctttcagaggcagagccctcatgaatggcaggattaatgccattattattgagtgggttagttatcatgagagcagattcctgataaaacggtaagttcagcctccttccctctctcactcttgtcttctcttgcctttccacctaaagccaggagatgacttagcaagaaggcctgcatcagatgctggcaccatgctctcatacttcccaacctccataaccataagtcaatacatttctgttctttataaattacctagtctcagatattctggtatagcagcacaagtgaactaagacacatagtgagcctttagcagaaccccattttcctaccaacctctcatgtcacctcccacaatgtgcattttcttttatttatactaaaagtgaccaaaaaaaaaagtttagaattgaaactatttccagttggtatcaagatccagatagagttaaccttaatatatatgtgtaaaaagctacaattcaaccgagtctctaaggcttcaaatatgaaaagaaataaaatgtgtttgttgttttgatttagccacaaatcagtgatttaatttagctactcttttccaaatgactatgaatttgatactgagtcagtgctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccaactatggtaattgttgctcctttttttccccctctctgtttcacctgctcaatgtttaacataatcaaggtgaacttttttagagaggcttgcttcatttttcacattgctatgaccattcctacagtcattgtcaaatgcagtcataaatcaaatatctggacataggagtttaggctaagtaagttacaaagttgttttggcgtccaaaacttaattgtataaatatctccaggggatggagatttctcccctgaaaatagagcacttggaacagaaattcagattgcttatttcatataatacaaattccttataaaacaactctttaatctacttaaaatccaatagcccattaaaattatcatcttatcttagaccccattataattcttgtctcattccttcctttcattctctctgtctggcttttttttttttttttttttttttgctaatttttattttcttaattgcattgcatggatgtgtacattttgtttattctgttttgctttgctctgatcatgagggtctttatacttggaaataacaaagtgtaacttaaaaatacaaatatactttttgtgccacatttagagaccaaattcttgattaattattggatcaacatgagttctgggataattcttaaaaacttagtgtgtcatcatgagaaaatcaaggataaccattatcagaagtaaatgtgcaaccagttaaaaattcatatattataggccctaattttatttctctgtccacccaggctggagtgcagtggcgtgatctcggctcactgcaaactctgcctcctgggttcaagtaattctctgcctcagcctcccgagtagctgggattacaggtgcccaccaccccacccagctaattttttgtatttttagtagggaccaggtttcaccatcttggccaggctgatcttgaactcctgaccttgtgatccacccgcctcagcctcccaaagcactgggattacaggcgtgagccaccgcgaccagcctgaaatatattttaatttggttttgcacatcattaaattggtttcccatcatctttgactagcctttctatagttcctgtatttctaagttctcaacatggaaatcaactagttaggatacaggccggtcacctagactaccaatcatctgaacttgatttggaattgatcagtaagaaaaagcaggctccctgcagtgcttctaagttttgttaggtgaatggtcacaggatattttgttttcgctggcatcagttgttgtgagtgaagttcctagcatagaagtggcttttgtagtcctgaagcaggtagacattttctataaaggctctatggagtagaagttattgtttcaacagccagtttcatggtgtggtttcagccaacattcctagaagcttagccctgatctgggttttttagttctcccaataaatttatcagctgcccacacctttcattttttgccttcagttttattgtgctataattgacaattaaaatttcatatatttaagatgtgcaagttaatgatttgatggacattatgaaacactcaattaccacaattaagcttattaacttctatcacctcctgtagttactatcatctatttttgtgtgataagaatagttaagatctatcctcttagcacatttcaagtatataaaacagtatcaactatagtcatagtgttgtgcattaggtctctagaacttacccatctcacagaattaaaattttatgccctctgactgagagcttctcatttccccctcccctcagctccttggcaaccaccattctactttctgcttctatatgtttgatgattttagtctccatatataagtgagatcctagagtatttttctttgtgtgtttggtttattttactaagcttaatgaccttcaggtttatccattttgttgcaaatgaaattatgttcttcttttttaaaaattaacattttgttgcatttataaaccacaccttctttatccatccatccactgcaagacattttagttgtttccatattgtggctacttagtgaataatgctgaaatgaacacagttgtgcatagatctcttaaggaccctgattttgtatcctttgaaaatgtgccaagaatcaaggttgttgtatcataagatagctctatttttatttttgttttttattttttttttttagcaacttctgtattgttttctataatggtcataccaattcacatttctcaaaagaaacatacaaatagcaaacgggtatatgaaaaggagctaaaatgaactaatcatcaggaaaatgcaaatcaaaaccacactgaaatatcacctcatacctgttagcttggtcattatgagaaagaaaaaaggtaagtgttagcaaggatatggagaaaaggaaacccttgtacactgttggtagaaatgtaaattgttacacccagtatcttttttaatacactccctttagctttaattaggtaaaatccaatattgttgcttgtagtcaagaattctggtatggccttcctcaaactgttattcaattaaaggacacccgaagatatatgaacatagaatgatgtatgtaatatatatagaagtcaagaaattctagcttaggtcctggctccaatgtgttcttactgtatttgagcaaatcaattaaattttggcacttcacttttcttgcatgtagaattgttttgagaagagaaatttttattttttattttatctttttttacaatttttgtgggtacatactaggtgtatatatttggggggcacatgagatgttttgatacaagcatgcggtgtgaaataagcacatcatggaaaattgagcatccatcccctcaagcatttatcctttgagttacaaacaatccaattacattatttattttaaaataatgaaaaaaatgcaatgttttaaatttctttttgttcttctcagtattttttaaaattcttgagccaaggatatatatttcatatttaaaagatgacttcttattcttgatgcctatattcttcagcaatgtataataagatcaaatgaaaaccaataattaaatgtcactactgttcttgtgtgcctaatgcatatgcattccattgtttcatggtattcgggtctgttttccttgcacaacttttcattgcgctagtcttgacttttttctgtcaaggaagacatctttaaaaggtacatagacactttataaaaagttgttccttctgggcacttatgtccataggcgaactgcttagcaaaggctcagtggcttgctgtattctggtagaatacagccctgtgcaagaatatagccagagtatagattgacattcggccacctcttattctctaagctgagttgttttgtgtagagaacaaatcacacaatcatatgaagaaggcttcttatatctacatataatacatacaggctgggcgcggtggctcacgcctgtaatcccagcactttgggaggctgaggcaggcggatcacgaggtcgggaggtccagagcagcctgatcaacatggtgaaaacccgtctccactcaaaatacaaaaattagccgggtgtggtggcgtgcacctgcaatcccagctactcgggaggctgaggcaggagaattgcttgaacccgggaggcagaggttgcagtgagccgagatcgtgccattgcactccagcctgtgtgacagagcgagactccatctcaataataataataataataataatattacatacatatatgtatttatctacattcacactttatatcagtgatgatattaaaattagacatttaaattaagtttggtaagtcatttcattttactagaatttaaattactgcctacttcttacaatttaaatatgttaagagactttggaaataattggaattcactaataactttatactgaaaaacattttcaatttgcccaaattgtatactaatgaatataatacataaggtaccaaaaaagtatacttaagaattacaaataattaccaatgttataaaatactatcaaatattgattacaaatttttcaaatttttggttcatcagcagggaaaatttttatcctctggaaaatctaagtatggatatgggttaaggtcctgaattttattattattctcactatcagttgttgtaatatttagaaactataattaacaataatgcttaatgtatatctcccacttttttattgttcctagtactatattgagaaaaaaaaaactaataataaaatgggggcaagtactggggatttctctgtcaagcaaggaaatgcttttctcaagaaaaatctggaagcttgtcagtagaatgtgagaaaggaaagacagttggtatttagctgctgagctcaccacctcctgtgcttattacattcttaattgtttctctcttaccccaactgggttcatgatgcaggaccaaggatgtcaaagtagcactagtattttcagagcagtgcattagggcaacctaatgcctgatctttccatcctaatcttaaaaatgctcaaaccccatgtctaagcttttgctgttcaacacatcgccactagtcacatgtggccattcatatttacattcacattaaataaaattatatattcagtctgtcagttgtactagccatgtctcaagtgctctagtcgcctatggctatggctacgatatagggcagcacacactgaacatttatatcattgagggaagttctattaagagtcctgacctagcacttacttaaatgctaatttgtatttttaacttacagttccctggcatcttgcttgaaatactctggtgacatagtaaaggtctcattcccatactgaatgtgttctttccatttaatagttgccactaggtaattagtagtgtctcatgggatgacagacagcagagcacagcagtcacaatgttaccgtgttttagcctgtaaaccttttgacaaaggcacatgttcctttatcacaacttgtttgtcaaagtagagtaattaacatattgcatccaatctgagataccatcaattgaaagatataccattattttgtattttcatgaacaattaaattaatgacattccgtttggtctacagtctgcccaattccagagatgttaaagtgtgaaaaaagtgtgcaccttaggtttattgaaatttaaaataagaagccaaacttttactcatttccaaaattgaatcttattgcaacatacagaaaatgaagcaacttaaatatagaaaaccttgcttgttagtgtttcaatggattgagaggcttcttaaaatacttctctattcctttattcattttatgtatcttgctatattttaccccactctaactctcttgcttttgggtgttcagttacacatacgttagaatattttatattgctccaaacttttttcctaatacttcttctctttgtattttaatttgagtaatttccactaacctatcttcaagcttaccatttttttaatggtgatatcgaatctactaccaatcagtggcaatttatatttctgttttttattttttccatttccagcatttcttttttttaatttcttttttataaattgtttattttaggtttggggtacatgtacaggtttgttttatgggtaaattgtgtgtcacaggagtttggcatatagattatttcatcacccaggtaataagcatagtacccaacaggtagtttttttagtcctctccctcctcccatcctccaccctcaagtagaccttggtttgttccctttgttgtgtgcatgtgtactcagtgttcagtttccctcataagtgagaacatccagtatttggttttccgtttctacattagttcatttaggattgttttagtccattttcatgctgctatgaagcatatctgagactgggtaacttataaaggaaaggggtttaattgattcacagttatgcatggctggagagttctcaggaaacttacaatcatggtggaaggcaaaagggaagcaggcaccttcttcacagcgctgcaagaaagaaccaacaggggaaaccctcacttgtaaaatcatcagatctcatgagaactcgctcactatcacgagaacatcatggaagaaaaccacccccatgatccaataatctcccaccaggaccctcccttaacacctggggaattgcaattcaagatgagaagtgggtggcaacacaaagccaaacatatcaaaggttatggcctccagctatatccatgatgctgcaaaggacataatctcattctattttatggctgtttagtagtccatggtatgtatgtaccacattttctttgtttagtctcctgatgatgggcatttaggttgattccacgactttgctattgggaatagtgttgtgatgaacagacgtgttcctctgtctttatggttgaacaatttataatcttttgggtatataatgaataatgggattgctgggtcaaatggtagttctttcaggttctttgaaaaatcactaaattgcctcccacagtgtctgaactcaattacattcttaccaacagtgtataagcgttcacttttctctgcaaactcaccagcagcagttattttttgactttttagtaatagccattctgactggtatgagatgactggaagaaggtacctgcttcccttttgcctttcaccatgattgtaagtttcctgagacctctccagccatgcataactgtgaatcaattaaacctctttaccatctcattgttatatttgcttttctctaatgattagtgatgttgagcgtattttcatgtttgttagccatttgtgttttttctttcaaaaagtgtttgttcatgtcctttgcttaatttttaatatggttatttgtttttacttgttgatttgtttaagttccttatagattctggatattagaactttgtcagatgcataaattataaatactttctccagtctgtaggttgtttgtgtgtgaatagtttctttcactgtgcagaaactcttcagtttaattaaatctcacttgtcaattttcatttttgttgcaattgcttttggtattttcatacaatcttttccagtttctatgtccagaatagtatttcctaggttattttccaggatttttatagtttcagggttttcatttaactctttaatccatcttgagttggtttttgtatgtggtaaagaaagggtacagtttcattcttctccaaatgtcttgccacttatcccagcaccatttattaaaaagggagtcctttccccattgcttgtttttgttgactttgtcacaagattatagttgtgcagctttatttttgttttcttttacgtgttccattggtctatgtgtctgtttctgtaccagtcccatgccattttggttactgcagccttacagtgtagtttaaagttgggtaatatgatgcctacagctttgttctttttgctttatttctagcacttttatttccttctttcttatattatattatattcttttatttcattctgctgccatttcccatctaatcatgcatatgtcccaacttgtccactagattctttaacatagtaatcatctatatattaaatttcacaggtgggaattttaatatacagatgattaatatgttaaatatatgtgtcatatataagcttagttctattgttttatcttttgacagtgtattatttattttacttgcatctttgtgtatcttataattttggttagaagccatatatcttcagtacagtagtagaaacttattaaattgtttatatactttatccagaaattaccttttttttggtaagccctttattatagggagttgtgccaatattcaggtgctgagtgctatggtttgaatgttcccgccaacattgatgttgaaatttaattgccattttaacagtgtggagaagtgggacctttaagagatgattaggtcacaagggctccacttttataagtgaattaatgccattattgagaaagtgtgctcttgataaaagcatgaatttggcttcacttttctctctgtcttacatgctcattcaccatgtgatgccttccacaatggaacaaaccccaccagattctggtgtcatgttcttgaatttcccagaccccaggagcatgagccaaataaacttctatttgttataagttatccaggctgtggtaccctattatagcagcagaaaataaattaagacactgagtttctggtttgctgcttctggtcactctcagttcaccacaggcttccaaactctctgatttaccttatgtttaaagggtgggctggtctgtcaggtagtttctctcgatgtctcatccactctcaaattcagatctcccatgtgcacttctgtctcagagaaggtcgttctttccacactcttataattccccctggctgtagactgttttgtattactcaacactttctagcctagtgttggcagaaagggaggatgacatttttcatttttctgttttactatcagccttaggtaggaaagtatgtcatgagttttgagggtagaacccaatatgaaaatcctactgttcttttatcagtataaacttatttaataatctgtgcccagaatgtatttcaggccttcccttaggattttttttcttctatttctcctgagggtagaagtatttgctgctattttgcaagtggtataaagcttttgttctacagtaaatatagaaaaggatctggtttcttagactaggggaatatgtgttattgttactgttattgagtaggacattgtaacaaatgtaatctattgctgatgggaatgctattagcaaaaggtgtacatttggttttggctatcagttgagaagtaatctatagcaaataagtaaataaaagcatgatgttttattgtatttaagtgtttaaggtcaatagcttgatcttcagagataaaactaaaactcactattgaagagcatgaactagacagtcagattagttgtgtactgtagttaatagaaaggataagaatgcaaacgggaaaaattaaagtcaattcttagtcttcctgcgttaatttaaattgtgtttgcaagtgatttaaatactttcccaaaatgtcttaaggaaaacgacttaaatggttcatatagtcagaaagttcccaggtagttctagctcccattgtgacttaataatacatatctttatttatttttcttggtttctttttccatcattttggtcacacttaagacagatattctctgtggtggcaaaattgctccagtaatgtcccacgtctttccagatgaaagtgcagccagaaataatgtttgcttctgttccagatttgttatcaaacattgcatgatgcttattagctctgagtagttacatagccattgtatcagtcattgccaccatagcataatcaagcctctgacatggtatccctggcatctgagaagagccagattccttctaaacacattgacaaagagtgaaagaaaactatattccaaaacaatattagacatttttaggagaaatagaattaactgatgccagttgtctgttttagtcaattgggggtgctataacaaattaccacagatgggtagcttaagtaccagacatttatttctcatagttctgcaggctgggaagtctgaggtcaaggttctggaagatctggtatctggagagggtctgccttttggttttcagatgcagtcttctcattggatcttcacataacagagatcagagaataagcacactttcttgtttctcttataagggcactaatcccatcataagggcttccagctttatgatctaattatctctcaaaggccccatatccaaatatcatcacattggggattagggttttaacatataaatttggatggagaggacacaacattttgtccacagaagtggccaaaaaaacaaaaatgactattgtattcaaagatcattgatagttttcatttacttgatatttcagaaactcattttctcatccttttctagtattcatgtttctctagaattcaaagacatactggtctaatattaaactgtgttcaccatgccaatttaccccagtttttgtaagctttttatcttaggttcagtctaagagtaaaaagcattgtcttttattgtaggttgcaattttgagaggctaagttgtgaaagagcagaaatgtgactacgtttagaatcttcttttgcaactaactttacttttaagctgttttatgctgagatatatacctaccacttaaaatatctcaatcaaagtctacgttaaagctgccattctcaaataaggactatgtattcatttgtcatttaaaatatattctatcatgtaatcctttcagtcaattcatggggaagataatattgtctacttgatgctgacattgctctgatcccaatgataggccaaataaaagttagattaaaaggcatctccctctgacttcaaaatttttgctaattttaatgtaatatgatatgtggatgaacaggcaaaaaattgagtcacatgagttttcatgttttagagaaactattggaaaaaaattgttaagccatgtttgagaaataaagaatattcctggtttctaatattatacaaacctcagttgattattttaaactagtgatgatattcagggcatgtctaaaaaaacactgggagtataactgtgttcatggttgatataattaattttgattcctgttttcattgttcataaaattataattttcaaagtatttgaattctaaatgttctgttttatccagtttttctttttaaattcatataggtttttaactgggtaaatgagtaagaaaaatatatacatttaatatttgagttctggtcttaaaataactataacagttttataaaccaagatgatattttaatttaattatttaaaaaatatattttttggtttgcattgacttactaaatagatttgcagttcagaataaatcataagtaaatgttctaacttgaactaggacttaaataaaaaattaaattaattcaaagttttcattcaaagtctagttttgtgctagttcatttggtagcttttagcctcaaatagctattgagcactggtagcatggctagtgctacattttgaaataacaatattttagatatgttacattaaataaaatatattattaaaataaattacagctgtttattttcagttttaatgtgactgctagaaaatttataactataattgtagcttgcattctattagacagcactgactagatcaatctgcagatctagaaatttagaaagccctttagattttaaatcttctaaaccgatgcctacaaaacaccaatatttaaaatcattttctttctcttagctaaccagcagctttgtgagaatttttattcagcatttctagagaccagcagctttgtgagaatttttattcagcatttctagagaatgctgaagtcactgaatctcaccacttgtgccccatctgtatttatgcaaatggaatagtgtgacaactgatatgtaaaacaatatattttattatgtgcatattctgttattcatagtgtattcaaaaccacttataaggcaaaagaactggtagatgagattgtctaccatcatatactcagtattgacagctgagaacagttttcagtagtagaaatatgtgcattttcttgagcataactagtggaatgttgaaaaagtagtactcattgaggaattatgccctgtatttgaaaatcttttagttattccattatagaccttggtgtgcttttgaggtgctcttgaagtgataaagtctttgttatgttggttggttggctggttggatggttaattaatttggtatcttggtgtcatatttcattagcagacacacttgtacaaaatactctatttttttttcctatgacctaatcaggtcattttgtttgtgcatcaagaggcatgatacccatttcatgtaaatcatttctagatagttagaacataactgtaaaaaatattgaaaatgaaggacaagggcaagaaaaaaatgagctctttaggaattagaacaattattattttcctacagatagcctaagaaaatgatgcacagttaaaagagactaactacaacatttaaaaatttttatcttgtccctgatgctttcgtttccttccttgattgattgtcatcatggcgccccttctttctttctttctttctttctctctctctttctttctttctttctctctttctttctctttctttctttctttctttctttctttctctttctttctctttctctctttctctctctctctctttctttctctttttattgagacaaagtctcactttgtcacccaggctggagtgcagtggcctgatcttggttcactgcaacctccgccacctgggttcaagtgattctcatgcctcagcctcctgagtagctgggactacatgcaagtgccaccacacctggctaagttttttgtatttttagtagagactgggttgcaccacgctggccaggctggtctcaaactcctgacctcaggtgatccgcctgtcttggcctcccaaagtgctgggattacaggtgtaagccactgcgcccgactatcatggcttatattttaaaaagtagttatgcagttatatataacaattaaaaccctcgcctacatagcttaatatgagtctctggaaaattttttcctctactctctctccaaaacagaacaatcattaatgatatagtttgggatttaattgatatcctttgttatactgtatttccaatgcagccaaatgcgattttattattcagctggctatcttttattcaatgtcaggatgagttaatcactttctttctaatagttaccacatatcagtgagttaatgtcatgatgaatatatccagaaaggaataacataggctaaaatagaatattataagaaatattctctatctgcctgtttcacttcaagtattataatattgaatgcaattgctaattaaaagtttagggagtcaagacatgcctaagagtacccagataattgacctagataatcctaataacaagttaggtgccttaaccaagtcattgaaagaatcgtatttcttctgtccagtcgtgtgtcagccactagttgttaaatatctcctgatacatttcttaattcctcactctgtttcctaaactgttcggtatgtaattgttacctggactctaaagtttctttttgtatggactaggtgtgatatttcaaacctgtgctttttactcatattttgggttctgactgtgatatagcactgggaggagattgtaaaacatctgttgagagtcactgccttatctatagtctgaactaaaaatgtctctcttcagatgactccaagagttcatatatttataaattgtatctaatgatttttatgattcggaaaatttgaagaacgtcagagtacactttaaaaatggaggaaagtggccaggcatggtggctgacgcctgtaatcccagcactttgggagaccaaggcgggtggatcacctgaggtcaggagttcgagaccagcctgaccaacaaggagaaactctgtctctacaaacaaaacaaaacaaaacaaaacaaactagctgggcatggtgacgcttgcctgtaatcccagctacttgggaggctaaggcaggagaatcgcttgaacctgggaggcagaggttgcagtgagccgagatcatgccattgcactccagtctgggcaacaagaacaaaactccatctcacaaaaaaataaatgagtaaataaataaataaataaataaataaaggaggaaaggaaaatttggagtcataaaatcagttttctagtgtcaacatggcttttggaatcaagcacaagtgggcacagaaataaagaaaacaggcctacatacttcatgatgtttttttttttttaagatttttttcttatttttcttatttttgctgtaaatcgtatgtactctctccaccttgccggcagttacatgcttgtgacatgtatccttcctaagagggaaaaaatgttaattactgaacctcagattctgatgcctggtctgatttatagtttatgggtgatgtgtttggcattttcaaggctcagttggttttgttgagcttcaggactgaagacttggtcccttaaagaagaacattctgcttttagtaataaccaggttaatgtgggccacatgccagtccagctgaatatgcatgaagtgattgaaattgaaagtcagttccttacatgtttgagtttcatgctatgaggaaccttacaaatagaggtcagagggatttttatgttgaaaatcagtagagtgttacctttgctatggaagaaaacaactttcttccgatattaatgtcagcattagagtaattgctctgtgaaactctgtctctagagttccattctctcttgaacaacaaatctttatcatcaccttagtattcaggtcatttttcataagtagcacataaagaacacattaatctttatagatgtctgcctatatttttatctcaaggttagttattgtcaaatattgtcaacccacagccttttcctttgccaagagttctctattaactcctccaataacctcccatcttttaaaataaaaacattgattttccctcaaagatgttatcattacctggaaactgaggcaaacaaagttaagtcatgtgttcaagttttcagtgtaaatgctgaaccagacacacaatccacacatatattttaatccacaaactcactattaaagttataatgcagactttgacgaatatgacgagcaacatattaattaaaaacctgaacaagtaaataatgttcatgaccaatataaatggatgctttaaaaaaaaatgactcaaacagatgtcatcaagatggcttactagaagcctctagcactcacctcctccacaaagaagaaccataacagcaaaccacacacattgaataggatgtttaagggagaacaatgaaattcagcaaggaagtgatgaagaccatctgaggcatggaagcttgagatggtagcatagagagggaagcaaagaatctggccaagattggctcagagccaagaggtactccccatttctgagaataggtgagtggggaatgccccaaagcccacattttgacaacagatacctgcaattctagctatagtagagcccctcaggcctcataggccctaagttcaccagagggagttgcctggagttcataggattttattatcccagagaaaaaaaattaatgctagatcaccttcactcgttgggacccaggttattgcagcacaatgacattttgagagcatggtcaccatcagagtacatccttccctgaggacgaatagcccctgcatttccacatccctggggcctgacatccatcccacatccattcagagggttgcagtgttgcgccaccagctggacccaatagttcagctgtgactgttgtactgaagcacatgcaggaccctccatcctagagtataaatagtctagcacagtgaggaagctttcccccggacggagaaagctgacatgcatattccccagagccttcaagccaccagttcaaggcataacaccacaaccagcaattacatttactccagcagcagagatgccatgaacttgtgcatttacttgaagggtctgaaggctggtctgcctggtatccccacctctgagcaaacttgtgccatggcaaataatcacagaatggccacaaaggcacttagagacactgctgacattgattaccaaataatttttatagagactatattactgtgcccactcagaaccaaagccaaagtattttatccaagtaaaactgtaggacacacatagagaaaaagatctttccctataaaagctacttcataaaactggaagaagagattgttccaccagatgcacagatattaacataggaataccaaaaaaaatatgatttagaaattcaataaaaagatagctgtattaaaaaagaaccaaacagacatattaaaattgaaaaattaaataaatacaataaaaataagtgcttcatcaatagactaaattaagtagaagaaagaatttctgaacttacagacaggccttttgagataaatgcattagccaaaagaggaaaaagaataaaaatgaatgaagcaggactacgggacgtataagaggacattaagaaaacaaatattggaatcatggaagttccacattaagcagagaagaagaaaaacatagaaaacctgtttaatgatgtaatagctgaaaactcaattcttggaagatgtgtggcatgcagataacaagctcaaatatttccatgtagatttaacccaaaaatgtcctctctgaagtacaataaataactatcacaagataaagagagacttctaaaaacagcaagaggaaagcatcaagacacctatgaggaaatgtcaatcagagaaacggtaaatttgttagtggaaactatacagatcaggaaataatatgataatatagtcaaaattcagggaaaaacagacaaattaccttccagccagaaatataacactcaggcaaaactatcctttagaaattaaggagaaataaagtgtttcccaggcaagcaaaaattgagggaattcatcaccactagactggtcctacaagaatgcttaagaaagtcttacatttgaaagcacatgggcaatctctaccattataaaaacatataaaaatgtgaacctcactggtagaacagataaataaatgagaaataaaacagaatcaagttaaatcaatatagaaaatcaacaaactgcaaagataagcaataagagaggaagaaagaaacaaagaatttgtaaaacactagaaaacaatgtaaaaaatgataggagtaagtttttcccagtcaataactgactagcatgtaaatgatttaaattccccaataaaaagatacagaatggctgaatcgattaaaaaacaagactcaactatatgctgcccacaagagactcacttcatttgtaaggatacatgtagactgaaagtgaagagatggaaaaagatatttcatacaaatggaaataaaaagtgagcaggaaagctatatttatatcagataaaatagactttaagtaacaaaaaaagaaacaaagaaggttattgtgtaataataacaagatcaattaagcaagaggatataacaatgttaaatatgtatgtacccaataccatagcatccagatttacaaagcaaatattgttagaactaaggggagagagagtctccactacagtaaaagctggggactttaacgcctgactctaagcatgaaacatatcatctagacagagagtcaagaaacataggtcttaaactgcacttaacaccaaatagacctaaaaggcatttataagtcattttatcctttagctgcagaagacacattcttctcattagcacataaaatattatttagcattaattatacttagagccaaaaacaagtctcaatatatttttgaaaactcaaaattatatcaagtaagaggaagcagagcataaaactttagaaaattttcagtctgatgatgcaatagaaaagaaaaacccattttctgaagagaaattcaagccagctgcagaaatttgcataagtaatggggagccaaatgttaatcaccaaggcaatggggaaaatgtctttaggcatgtcagagcccttcacggcatccccgcctgtcacaggcctggaggcttaggaggaaaaaatggtttcatgggccaggcccggggcccccctgctgtgtgcagccttgggacttggtgccctactttccagctgctcctgccatgctaaaaggggccgcggcacagctctggccattgcttcaggtgcaagcacccagtcttggcagcttgccttgcacatgatgttagtcctgcaggtgttcataagataagaattgaggtttgggaacctctgcctagatttcagaggatgtatgggaacacctggatgtccagcagaagtctactgcaggggtgcagtcctcatggagaacctctactagggcaatgcagaaggaaaatgtagggttggagccctacacagagtccccactagggcattgcccagtggagctgtgagaagagggccactgtcctccagaccccagaatgttacatccactgacagcttgcaccgtgcacctggaaaagctgcaggcactcaacaccagcccatgaaagcatctgactgggggctctactctaaagccacagtgggtggagatgcccaaggttgtgggagcccacctcttgcatcagcatgccctgaatgtgggccatggagtcaaaacagatcattttggaactttaaggtttaatgaatgccctcttggattttggacttgcatggggcctggagcccctttgttctggccagtttctcccatttgaaatagttgtatttacccagtgcctatacccccattatatctaggaagtaactaatttgcttttgattttacaggcttataggcaaaagggacttgccttgtctcagatgagactttggactatggaattttgagttaatgctggaatgagttaagactttggaggattgttggaagggcatgattgtgttttaaaatgtgaggacatgagatgtggggggggtgcatgggtggaatgatatgatttggctgtgtcccccacccaaatcttgtcttgaattgtagttcccataatccctacatgtcataggagggacctgatgggaggtaattgaatcatgggagcagttaccttcatgctgttctcatgatagtaagttctcaggagatctgatggttttatagatggtttcaccccctttgctcagcactcttctctctttctgacttgtgaaggacatgtttgcttccctttccaccatgtttgtaagtttcctgaggccttcccagccatttggaactgtgagtcaattaaacctcttttctttgtaaattaccaagtctcagatatttcttcatagaagtgtgagaatgaatagtatggaatcattgtaagtgtccatcaccagctgaatgaattaaaaaattgtggtataaatatacaagggaataatatgcagctattacaaaataataaaattctgttatttgcatcaacatggataaacctggaagacattatattaagtgaaataaattaggcacaaaaagataaataccatgtgtatcacttgtacgtgggaacaaaaacatttagctcacagaagtaaagagaagaactgtggttattagaggcttgaaaatgtaggagtaagagaagatagaaagaggtttcataaaggatataaaattatagctagaaaaaagaaggagtcctagaattctatactacctcgggcaactatagttaacaataatttaatatatattttcaaaaatcctaaagagaggattttgaatggtcacaacacaaagaaataataaatgttttaggtgatgagtatgctaattacacagatttaatcattacatattatatacatgtataaaaatatcacattgtattccccaaaatatgtacaattttatgtcactcaaaaattttaaaattttctaaatgacaagaatattttaaagatctctaagtaaaaagttttaaaacatttttaaataaaatttttattcaacaatatttaatatgcttctcagtttaactagaatttaataagaataagatgttttaagtagtcaatatttagagtgtgtatatgtaaccaaaatatgaaaatgtattagtattctttacaattaaatgtgttttaaaggtgcaatataatccttgtaaggaaaaggcaaacaaataaataagtccacaattgaccagtaaaagacaaattatgtatagaatgtaagtataacattcaaataaagaaaaatgacaaattacagaacaaattgcattgagcaactttctggttacttggggaataaaaaacaaaagtggatgtatacctcacaccgtaaataaaaaataattattgcttaatgaagagatcataaattttaaaagtactagaagaaaaaagtgtgtgagaacttacaatgttaagctagttaagctacttttggcatgctacttaagtatgagaccataaaggaactaacttttagagtaaacatataaagttttaaaaattatctgtggaaaacacacaaaatgaaaacacagatgctaaatagggtaaaatgtttactacatacataaaaacaaagttataatctgtcatataaaaagagcttttagagatcaataagaaaaagatgaatgaattcccaagaacaaacaggaaaaagacactgatatataagttatgaatgaagaaacacaagtgattacagcttatgacaggatattcaagctcaatcataaactacaggtctaaatgatttgttgttgttgttgctgctgtcattgtcattgtttttccttgaaataatttaaattacctcaatggcaacatgattttattgtgactttgaacaaagagagagatgcttgtgtagcatgtaggactataaattgttttagccgtagtaaaaaatgactggtaataggaatcaaaatgtaaaatgtgcatatcttctgatctacacattttacttttgagaatatatcctaagcgtatgcaaaatatgtaataaaaataattttagagttttttatggtatatggaaaatatgaacaatctaaatagctattaataggtaaatacatatattataatacttggaatttatatttattaccatttttctaatatttaaaaaatcatttaacacaggtatgttaattatgtatgagggtatagtgttatgcaaagttacaaatacaaaatcaatacaactcattttaaggattttctatctctgcttggtagtaaaacttttatggaataagttaacaagttgcaattgaaatagatttgagcttttctggttgtaatctcttgggcttagcctcaggtaataaccaaaaaatttccatatatttttgtcctttaatcctcataataaaacatttggatatatattattttctctattcccttgatgagtgaattgtggtttttttcccctttctttcttttccttccttcctgccttcctaccttccttcctttccttccttcctttcttcctttctctctctctctctttctctttctccttctctctctttctttctttctttctcttccttccttccttccttccttccttctttcttcctctttctttctttttcttttttcttgtaaactgctaaggaaaacacaagctaagatttgatcctattgaaatgaagacaaccttttctccaaagctgcttggaaatgaaatgaccacttttcgaagtcatggtttattcagttaacaagggcttgtaatttcctatgtgttgaaacaataattttcatccttacaattctagttccagcactaaatggaagctaggttgggagtttggctctctgtcctattgcaatatatttatttctgcatggatatgctagagagaaaactagtttatagctagtgagacaatgtttaaacttatttcgctataaatgaaaaatcgcttgtactactttcagtaattgattttaaatgccattcaggttatcaaaccagatattttcaaatgatgataagtagaaaatagtttaatgccaactgatgtggaagttgcttatttgtgttaattaatgaggagaggtctggtccatgaaaatattgtattacaaacagtggcattgtcaatgaggctgttagtttactcaagagtgtagtatggtgaaagttacatgttaaatatcaattactgaaaaatggaacatctttgaaaaggaattttgcactatagaaaacgtcgcaggaactctaagagcaattctaagagcaatttaaagaaggtttttctataatataataagcttatttatataacagggaatatatcagaaaatgatttattctgcctgctcaaagatctcctttggggtaataaagtataatcttctggtattagctgctattaatacataggccagttgaattatatcctaggcagaatagccctacatgcaattgaaaaatgttgtccaggtgatttttggtatgcttttaatatttgagtcatcagccatccattgtctaaagtaaaataaatatatcaaataaaaacgtgtacttcattcatctcattaggttgtcagcatttacagttagagagtatttctgaaagtattgtatttcagttcagaggaaatacactataaattataaaattgctgacacagtatctaattcttttccactgtgatgcctactagacccaaataaaccaaagaaaagtataaatagtactttattatacatcttgtgtggggaccgcatcatgctgcctataacagaatgaccaaattggttttgtgacggtcagttttgttttgctttttaattagcaagtttatttttatgttttatagattttgtcgtaaatacagcctaattaacacctataaactgtgacatatctagactatgcaatattgtttactgaaaaagagatgaactatcaaggcatgaaaacacatggatgaaatgtatgtgcatattagtaagtgaaaaaagccaatttgaaaagtctgcatactggatgattccaactatatggcattctgggaaatgcaaaattgtggagacagtaaaaaaatttagcatttgctcgggattaggatggaagaagggatgaactcgtggaacacacagaattttggggggcaatgaaactatgctgtgtgataccgtaatcatgaagatgaatcattatatactcatcataactcacggaatatacaacatcaagagtaaaccctagtgtaaattatggactctgggtgacaatggcgtgttgatatacgtttattgattgtaacatgagtaccactctggtaggggatattgatagtggagaggctgtgtgtgtgtggaggcagaggtatgtgagtactctctgtaacttccactctattttgctgtgaacctaaaagtgctctaaatgtgtctatttttaaaacataaaataaaaataaaaaacctgaattttatattcgtaatcttcatacttttagtctcaccaccttaagtattttactgtttgccacttaccaaaatggtggtgcaattgaagaatggtacgtgattcctctatgttgtatcatagtaaagtcatgcttgcatttttttctttcttattgtagtagaaaagccatggatttcagaatctgtaagatcttagttccaattctagttatactagctgtgtataaacttatttcggtataaataaaaaatcgcttgtactactgtcagtaattgattttaaatgccatccaaacctgaaggatagaaaatatccttttaaggttataaatctatccaaacctgaaggatagataatatccttttaaggttatagtgaacattaagtaagaaatattttgaagtagtttaaaatactaataaatattaagtatacttttaatactcatatatattttccttttcaatcaatacttgtttttcgatgttcacaaagcttttgttaaaagggcaatgttttaaaaatatttctgtagagctgtagtttatcattgtgtgaatcatattacaacactagagtctcctagctcatagctaggagctagttagttcgtaactgtgtgaagaagataaatcttttgaaacgacaaagtcacgactcactcatcttaaaaggtatctcattatcctagaacaaacttggcatcattgtattactgacttccaagagaaaccaatcccattttgcctgtattgtctttcctcttaccggcattttttaataaatgctgttgacacagtagcttgctttctcacagttcagttttcctaactgtttgattccatggcaaatccataatcctattttaaatattctccaggccatgaaaatgaatgctatttatatcaattcggctgttcaactgcagtgcagaaaaagcttttgtatccagagatacaagcctctggttcaagcataaattactgggatacactgctcttttttcttttaagctgaactctccttgacacgaatccccataggtgtcttaggtaataactgatattccaagaaaaaaaattgtgaaaaacagttaaaggaaaagacaatttacatttttaatctgatagatcatgtttccaaaatgaaatctctcttaactctggtaatcaattaattcatacatatttccatcaatagatctttgaatagtggcttaattggtcttttggaaatgaatcatttgcaaaggtagagtcgtgcttcatgtactagctccctgaaaggtagtgtgcagaaagattaaatcgcaaagtggattgtaatcaggcagatcttggttcagattgtgactgtttcctacttaaactttcagttttaaaattgaacttggcagagcttattttatgaagtatgaataatatttacttcttgagtaaataaatcttgaggttgatttaaatgttaagtaatataatatatgtaaagcactatgcagaatctggtatgtagtgaaagctaaatttgagttattattatatgcaggactatcttaagtttgacacactagctgtatttttctaaactgtataaatcacttcgactaagtcaactagtatatttctatgacgtactcataaaaccaaaaagattaatcatttcttggaaagcttatgaacttataatatgcagtcctaattgaaccatgacctacaacagagttttccataccaatgtaatgtttcttggccttgttgcaccgaatggaacataagctccgtggggacagagattacatttattttggtctttgtattttgcaagttacctcatttatgaacttgcacataattagtattcaatagttacataattagtattcaatagtcatttataaactgacaacatataaaagtaaatacaggttatcaactgacactcttatttatcttattttaaaaaactttattatgataatctttttaaaaatagttattgtggtgcctgtatcaaagatattaacagaaatttgttaaataaatgaatgtagttaattttcatttacagagcatgaatgccagaatttggataacttctgtactttccttgtgttcaaattctggcaggactaaaatatgtctgtttttcctttcttccaataatatctcatgccatgtttatataattaatacagtagattattatccataaattacatatatgcaaattcaactacatgctaaagttaacttgtgccccacaaatctactcctgggtctttcacagtcattcatagacatatgcagaataacagaacaattgagttgcttgttgtctactttcccagctaaggttgaacgaggtgacactgtgccttcctgtttcagctcttttactgtaaacaattatcgttttgagggtctacttagtgacatgtttttcacatttttgtgctttctgttggtcatgttcctgtttaaaatcacttcccaccagtcacttctgcccccaagcatagtgatgaagagttgtcctgtcttccttagtgcaagaatgctgtgatgtgccttatggagcaaacacatgtgttagataagcctcattcaagcgtgagttatagtgttgttggctatgagttcaatgttaatgaatcatttaaaataaggtgtctttaaacagaaacaaatatgaagtaggttataggttaaagggttcatgaaaatgttgtgaccagaggctcacaggaacctgatcctgtatttctcctaggagcaatgattcagtagttgctaattcagtgtttatgctgagaatacaggtaaaaacaactgcaaacaatgaaaattgtctataccacttgtagtagtcaactcttagtaatcaaactcttcttagggttcacagtataatatagagatgatgggtaccagattggattacatgatcttttgatgttttctgagtctcctaatacttttcttgatgggattgaatgattggatatcttaaggccagcttccagaaataagctgatcaagttttgatatggtatattggaattctgtccactcccactgccttttccataactattcacactctaataagtagtggaacatcatttgcagagatgggatgaataggtaatttttggctatgaaatttgcttgtccccataggtctctcagatgctcagtttggctttcactgtgcagcagccaatcattacaggaaaaactgttactcttcctaatcttaagtaactttgattttaccctctcgtcatgaaataagacctacttagccgtatggaaggggagtttaagataaaggaaattgaggaatgttaaaaaagagtagaaatgttatccaaggaaggagagagaaagagatgcagattagcacagggtgaatttagaccagaatgccttaatacagatgttcagtaaagctaaatctaattctcattgaaaatcccccctccctttaaaatatctccaacactatgtcaagaaagagagaaagagagatagaaatttcttcttccaaccttgttcaagattttgccctcccccatattctttattctgttgtgggcaaggaatgtgatttttcttattgaaagttaaaaaacaggaagtatttgagatctgctgggaacacacacacatgcataaaaagatagtgaatttggaggaaagtgttctaaactcagagtaaagggctaggttctaattatctgcagatggcaaattgctggctttgtaggatggatggatggatagatagatagatagatagatagatagatagatagatagatatggatgaggcccaagcctatatgttactgcattctgctgtgggtttgcagacaagtctagtttaacttctttattgcagtcttcacctcaacacacttactgcaagagacaatattgttatcaggctaagaactacagaacagaaggtggatttatatattcccttctccaatcacaccatttgaagacatataagtcctctggatttacaattagagaacgaccagcaacctctataaaaaatagtgcagaaagagaccaagattcaataattatacacagttgttaggtctcagtgtctgctttgcctaaaatgataatgcccagcaactttttctctttagatgtgtgcctaaaagccaggtacagtgtggtaggtgactcaaagataggatgaataccctctttccccccacgatatcatgacatatttgtcttctttgaagaccaagaactcacttggcagtttgctttggcagcagagctttctgagagagagagaaaaagagagagagagagagagagaaaatattgacagaagtggtcacatttctcatctttttgtcagctctggtagtaaattcaagatttaaatttgtagtaagtatggaactttatagaacacaaagtaaatgtcaaagtagacaccaggaaaaattatttttgcttctacagccctatcacaaaggcaatctcagatttaatagttattccaaaaggagcgggagcataaagcttcattgtaaaacacaatactctaacaaatggtggaaggcttgcaatttcattgcaaagagagaacatagcacttctttgccaaatatgtggcaaatcatatttaattgaagctattattccagtgagaagaaataacaatttgacttctagggagttttaattgacagtattataatatttgtgcaatgtacatccactacaagaataaaagaagcttttacaattgcatactgaaaaatgaaagtatcaataaaatttctgtaaatcctggaaataataatatcacaatatagctagctaaagaacaattttcttcactagattcacatagcttagagaaaaataattttcacagaaatatactcatcatctctttccctaacccatcttttgtaattttcctaatttcctctgtattccactatttcatcatctcattattaagaagcaaaacatagaggcatttttgcattatgcactacagtcttttgtttgaaatttaatgggtcatgagttctgcagtccttgggaagatagtctttaaaaaaatggggatttttagatattacatacttgtagccatctgcttaatatgtcattttcaaccattactatgaaggtgtggagagtgttatctcacttcaacttcaccaacaaacacttcaacatgcattagtttttttcctatcagaaccatcactcaagaaataccagttgaatgcatataaacatggcactgtgctaggtaatgtggaggatgcaaaggtaatagacacctgtatctgacaacattctagtaggaaaaggagacttacacaaaatgtttatatagtttcactacagagtgagatgtgtcctaagagtcatgcaggaaactgtgcgagatggatttcagtagaagaaatcaatatgagctccatacgggggctttattataaggggtagaattctcacctcagttaaggtagaatgtccttgggggaaaagcaaaaaaagttcaggacacacagggagaatccatctaatttgaagtatagacgatgtaaagagagggagtgggtgataagtttagaaaaacatgtaaaagccaaaataacaaaattatttaacatcagatgaggcagtttgaactttattttacaggcaatagggcattagtgaaaattttgaacaagaaagtaacataatcacaattatactcaggatagagtggattaaataagcaatggaattgatattagaaagaaaaattaggcataaggcacagagagggtgataaacttctgagctagaatgttttatattttcatttctgcctaacaccaattcttggattacctggatgttactaagaatatatatacatatattcacattaagataaagctatgatcaataatgtttcttttttaatttcagatttttcattattcgtatactgcttcatatgtgatttacaacatacacactaggtaagttctttgattttctagttttcatgagcaattgtgttactaaattgttggtgtagatatcagtttgttcatgtaaaaatattcacattttttcaagggaagtttgggagttaaatcctccagaagtagaggactccgtcttgcagtacgcggcctggggtgtccaagggcagcagctggtaagcgcaggcattggtatgcactgaacactgccaatcatggttttatggaagatgttaactgaaactttggaaaaaccataggaaaacttgtcctacaaaactttatgtttccctaagtcctttatatcttttatctaatagtccaacttaagaatacattaaatgatactagtattattttatcagttaataaagacaaaagtttattaagtaatatatgattaaactgctggtttataatgaaacctagaagagattcaaggttactaggaccttgtactgcatactttccattacataatattgtcagttttcatgaaaaattcaaaataaagattattttttcttaaagcattgttcagggtaaaaatttagacagaattatttaatattctcttaagagaggatttttacttttatttttattttgaaattattacaaactcaaaaagataattattgatatataaagcagtttgagcaattatatatatatgtatgtgcatgtttattttaggcaaagtcttgctctgtcatccaggctggagtgagatctcagctcgctgcaacctctgcctcccaggtttaagcaattcttgtgcttcagcctcctgagtacttgggattacaggcacatgctaccaggtctggctagcttttatatttttagtagagacggggttttaccatgttggccaggctgatctcaaactcctgacctcaagcgatccacccacctaggcctacccaaagtgatgggattacagacatgagccagtgagccccgcctgcaatattatattcttgtacatatctcatggtgacaatgtaaagcctttctcaagggaatattgctcagggagtagtattgcttactatcctgtgcatgctcagatgtactgagcatcaccaaactgatttctaggttatttgttaagcgtgtttacacctaccagcaataatgagagcgttcccttggttccatatccttgccaacacctgtttttccagacttttaaataattactcaaatgatgatacaaaatagtatttcgttatagttttattaacatttagtatttccttgaattctaataagctagagcaacttttcatatggttactggcaatttgtattttttcatatgtgaaatatctattcatatatttgtccattcacattttttattcttttttttttagttaaaaggaaccccttatatgttctggatattaatacattgtttggtctatcttcatccagttttcggatttacttctcactctcttaatggatccatttctacaaacatatttttttataaatgtagtctgatttatcaaatacatgatttgtactttttgttattgatgaaatctttacaatgaaatcatacttctctagaatttttcaagtgggccttccatgtataggttcttgatccatccatctgaaattgctttttttggtatggtattaagtccctatccatttttatatatgttttatatggccaacaattgtcctgaaaccttttgttgaccacttcattctttaactattcatctgcagtgttacagtgttatgctgtacatatccatgagtcttcttccggctctttttttcttccaggtggtttgtctattagtgtgctaagacaacagtatcttaattaaaataagctttactagctgacaaggcagtttcatatgctgactttgactcttcttgactttttagcctttcatatgaatgtcacaattgtctttcatgttacatgcccattttcagaattttgaatttattatttgaatctatatgtctattttgggaaattaacatcttagtgatactgaatcttcatatctacaaacatttaatgtatgtatttagttatttaagactcttaatatctcaaattttacaattttatatctaaaaatttacactttatcattttggtgactcttttaagtgcttgcatttcttattttaaaaatgtttgctactggtaaatagaaaggtactcaaattatttatttaatatatatcaaccttgctacgcacaattatatattccaaataattctgtgtagactattatgctttttgttaataatgacatttttcttttccatttcaatttttataatttctatgtcgttaaaatccttctgcactagttaacctatgaatgtaactaggtatggtggggttttttgttttttgtttttgctggaatactaaaaaattgattctattatggttactgggttaagttttacaattttttttttagttagttttagttagtgactgcaattgatgagacatgctttatggcttgggattttttcaaaatgctttttatgtgatggataattttatatatgttctatatgacaggaacaatgttctatatgtgcctacaggatcaatcttaataattatgtttctaagagttatattttcttactaatgacagtggatatgtgatttttttctttagttgtcagttttgcattatataatttgaactatgttgtaaagaatgaggaagttataaaatgataaatacatctttctattgaattcaaatgttttataccttaataaatatatttaccttatttacctttaataactctgattggccaaccctcatcctatcctttaactagttcttttaacgtagtttagaatcctctaggcttttttaaaatttgaattgctgttttaacaacagctggttgggctgagttaagtttttaatttcctgcaagcctcaattttctcatctataaatagaaatatgtacaccatcatatcattgtgataattattttggaaaatgactatttttcataataagatgcacattactatgatttatatcctattttataaatctgtatatttcttaagcttattagtgaaatagggtaattataatagatatttcatatcatgagaagcctacagaataatacactgtggctaaataaggtttcctttcattggaaaataatctggaccctcaaatattcaaagaaatcctacaaacaaccctgcattcactgtcctttccacactaaatggttgaataattgagtaaatcattatgatgaaaaaaggttagtgatttaaaatgaaaaatgtctgcaattgtccagataccacagattatagacattatatttgcttttatcttgtagatatttagataaattaacaaacaatgcatttaatctaccatcacagaactctctgtaatctatcccactatgatatttctgaaaagtggcagcaaaatttgcatagaatatggtaaatatgaatgtgcagggtttggtctagataaggcatgtaatcaatgaaacattcatggacaatggtgagtggacaccaagaagtggcaggtgctctcatccttcctgtttcactctgatgttgtgaacaatagagctggtccattgggccagaagcaactttggaacaaaccaaattccagaacacagaaacccaagacaactccaccttttgtacaaaatactgcccagtattttagaaaaaaatggacagtattttggaaaatcttttacactttggttggttttaaatgaccctcttattcttcatacttgagggaaaccaacacctatgacaaaataatagcactttgatacactcagggaaatagtattaatgtatgcattttctttatttgttattgattccttattttttaatatatttaagaaaattatgaaaatactaaaaatgtataaaaattataggttccctgtttgaagccatattgcaggtgattacattctggttctactgcttactagctgttgatcttgagaacattatttaatcttgatatggcttactgtttccatctttaaaatggtagtgctttatcaatagtgctattctggtgtttaatgtatgaaatacagttctaaagcactttgaatagtatctggcctataataagtattttgtaggtattcacttttactattattaaaaaatctgttttcatatgaatttaaacaccttagggaactttagggtgactagttttgtggagaattaagcttaagttttctgtaatgtcatttttcaaactcctttggggaattcttaagagaaatttcatatttatctagtttatcttttgagtgcatgcaaacataaatttaaaaaagtaaaagacatacttctacaaatggccaatggtccatttcatatgagtttggcatgctttgtcaatatttgaagctattagcaaactcagcaatatgattttattagagatgagtcattacaatactttaattagttttgcattaaataaagaggcttgtagtgtttactaactaaggataattaattatccttcattttcagcttctaatcttatttgctgtaaaagaaattcctggtattatagaagagaggcaagggattgacataatttactgaggaagaggatctaagttagaactcagaatattgaggagaactttcaatagcactaagtgtgagtaaaggcaatttagatgtgtcaaaatttgtggaaaaatgaacctgaagcaataaagagtgcattatttggagaaggtggtgagtgaaccactttagctgtaataaagttttattgaatagaaatggtttgggaagaggaatctgggaattatggtagaaagagaagcaccaggaatctgtttttccattcagataacaattgctacagtagacatgtaactattgagaactctagtctattgaaagtgtgtaaattttatgggaaggcttgaatggaagtttgtggttaattttagttgacttgaactcttagctcagaagcagctacctatcttcgaccccagccccatggcaggcagctgtgcttatgttcctggagcatgcattcatcttgcaggaaccaggatggacaatgagggccctgtgatgcaaataagtaaggatttgtattcttattgtttattgccccttctcattatgaaattgcagatatagaggaaggcagctattgtttcacatccttacacccttataacaagctcctctccctccagctgaagtgaattctaaggtggttaaaaggccagtgccctttcctactcttcatttttctcttttttgagggatgtcagccattaaaaattaagatattcaaaggcaactgaatgtatgggagaaattagcaagtcaccatacatgcacagggaaagatgcaggcttacaaaagatctgagaagacttttttcacataaggctgattctcagcataaagacagcctccaacaattacaaaagaaccaacataacaaaacaaaagcaaaaacataaaatagaaaaccatgggaaatgggaatgtattagtccgttctcatgcagctaataaagacatgcctgagactgggtaatttataaaggaaataggtttaatggactcacagttccacatggctggggaggcctcaaaatcatggtgggaggcaaaggaagagcaaagtcacgtcttacatggcagtgggcaggagggcatgtgcaagagaactcccctttataaaaccatcagatctcatgagacttattcactatcatgagaacagcttgagaaaaacctgcccccatgattcaattacctcccaccaagtccctaccatgacatgtgggaattattaaaattcaaggtgcaatttcagtggggacacagagccagattatatcaggggagattctgatttccagagataccaaaattattagattcaaattgtctggttttcaacaataaaaaaattacaaagaatacaaagcaataaggaagtatggcccactcaaagggataaaagacccaacatcaagaaataatggaagtcatggaaaatatgaagaacatgatgtatgaacaaaatggaaataccagtggagagagagagagtaaacctaaaagacaccaaataaaaagttctagagcaaaagcttacagtaactgaaataacagttttactagagagtcaagatatacttgagcagggagaagaaagaagtagtgaaactgaagataagacaagtgaaatgattgagtattaggaacataaaaaataaaagactgaagaaaaataaacagaacctaagggacctatggaataccatcaagtggggcaacataaggattatgggaatgttagaagtagaagagggagatgaaggggtagaaaaaatatttttaaaaattaacagccccaaatttgatgaaaatcattagtataaataaccaagagctcaaaaaatccaaataggatgaactcagagacccacaccaagacaagttacaatcaaactgttgaaagacaaagacaaagagaattttgaaagcaacctgagagaggccctcctcgcttgtcacatacaacatatccttatcagcagatttctcatcagaaacataagaagccacaagacagtgggctgatgtgttcaaaattctaaaagaaaaacaaaacaaatcaaaatctgttaaccaaaaatttcatgtctggaaaaactgtgtttcaaaagcaagggagaaattaagacattctcagataaagaaaaattgacaagagttaccactagacctgccctgcaagaattactagtgggagtccagcaggttgaaatgaaagtacactaggcagtgatttgaagccttataaagaaataaagatcccggtaaatgtaaatacatgggcaattatagaaatgtatgttattgttacaatgatttgtaactgcactttttcttttctacttaatttaaaaagctaagatatttaaaatttttagtctaaaagctaatattattttaactttaatttgtatttcacattttttttagacataatttaagaaagtaatgccttaaatgtcattagttaatacctttggatgtacaatatacaaatatgtaattttgtgacttcaataattgagggaggtgaggatgaaactatgaatgagcaacgtttttgaatgttattgaggttaagcttgtataaattcaaatcagcactataactttatgatgttgcatggaaccgccatggtaacaacaaagaaaataataaatatacacaaaagaaaggaaatgagaatggaattaaaacattctactattaaaaattaaactcaaataagacagtaatgtggaaaatgagggtaacaaaagataagggatatagaaaagaaatagaaaaatcacaaaagtaagttattccttatcagtaattactttaaatataaatagattaaattattcaattaaaagaaactaagaagataagttttaaaatataatatgattcaactacatacgctctataagaaactcactgtagatacaaagacacaaataagctgaaaataaaagaatggaaagagatatttcatgcaaacagtaagcaaaataaaataggggttgctatactaacgtaaaaataggcgttaaatcataaacagttttgagagacaaataaatcaatacagtaagaagatataacatttcaaacatttatatacctaataacagaccatcaaaatatataaagctaaaaatgaatataattgaagggaatatatatatatatatatttctaccataattgttggtgatttcaacaccatactctcaataatggctagaaaaaccagagagaagataattaagaaaatagaggatttaaaaaacacagtaaggccaggtgcagtggctgacgcctgtaatcccagcactttaggaggctgaggcgggcggatcacgaggtcgggagatcgagaccatcctggctaacacggtgaaaccccgcctccactaaaaatacaaaaaattagccgggcgtggtggcgggcgcctgtagtcccagttactctgaaggctgaggcagaatggcatgaacccgggaggcagagcttgcagtgagccgagatgtgccactgcactccagcttgggcgagagagcgagactccatcttaaaacaaataaataaacaaataaaaaacacaataagccaactagacttagcagatgtatacagaacactcaacctaacaacagcgtacacgttctttcacgggcgtttgagaaattcttcaggatggatcatacattttgccacctattaagtctcaatagcttttaaaaaattatcacacaaaagatcttctctgatcacaatgggataaagttagaaatcaataacaaactgaaaactgaaaaatttctacatttgtggaaattagaaaacattctctcaaccagtgagttaaaaaattacagaaaaattagaaaatacttagagatgaagtaaaatgaaagcacaacataccaaaatgtatgagatgcagcaaaaacagtgtaagcgggaagtagctatatatacttactgctgtggaattaatggtgttcccacaaaatttatgttgaagccctaacctccaatgagactttgttagtttgttggagataaaagttttaggaggtaattaagtttgtacaagatcatgtgtgacgctttaatccaacaggactggtggcttaaaaaacagaggaagatctctcactctttctcttgctcttgctgtcactctctttcactcttgctctttgtctctctgtgcatactcaaaggaaaagtcatgtgagggcaaagctgccatctgtaagccagtaggagagctcttaccaaaaactgaaacatgttggaaccctgatcttggattctttagcctccagcactgtaaataaatatatttctgttataaactgcactgtctttggtattttgttatggaaggctgaaaggattaagacactcacattagaaaacaaaaaaagatctcaaatcaacaacctaattttacaactgaaggtactcaaaaaagaaaaacaaactaaacctaaagatagtagatataaacaaagtagataattaaaaacagagaaaatcactaaaatcaaaagttggttcttcaaaaaaatcaactaaattggcaaacctttagttagcttgactgaaaaaaaaaaaaacaaaaaaaaaaaaacaagagaagactcaaattcctaaaatcagattgaaagtggggatattatgaccgtttctacacaaataaaaaggattataatagtactatgaacaattgtataccaataaactggataacctagacgaaatgaagatagtaccaaaaatgcaaaacttcgtagtagagtcatgaagaaatagaaaatctgaataggcttatagttaatatggatattaatgcagtaatcaaaaacctcctggccaaaaacattctggaactgatggcttcatgggtgaattctactaaacatttttaagaaaacctaacaccaaggccaaggcgggcggatcacctgaggtcaggagtttgagaccagcctggccaacatggtgaaaccctgtctctactaaaaatacaaagattagctggatgtgttggcaggcacctgtaatcctagctactcaggaggctgaggcaagagaattgcttgaacctgggaggcagaggttgcagtgagttgtgatttgagatcatgccactgcactcctgcctgggcaacagagtgagactttgtctcaaaaagaaaaacaaacaaaccaatatttctcaaacttttccaaaaagtcaaagaggagaaagcacttcttaacccattatctgccagcattatcctgatacaaaaatctatacatgctacaaaaaacttacagatcaatttttcttatgaacatttatgtaaaaattctcaacaaaatactaatacaacaaattcaactgtgtaaaagattatacaacatagctaactgggattcattcttgaaatgtaaggatcattcaatatataaaaaactgatcaatgtaattgtattagtcccttctcacatcgctataaagaaatatctgaggatgggtaatttataaagaaaagaggtttaattggctcacagttctgtaggttgtacagaaaacatggctgggaaggcctcaggaaacttttactcatggcagatgggaaagctggagcaggcatcttcatgtggctagagcagaggaagggggtgagagttaccacacacttttaaacaaacagatcttgtgagaactcactcattatcctgagaaaagcacaaaagtgatggtactaaaccattcatgagaaacccactgccatgatttaatcatctcccagcaggcccctcctccaactttggggaacacatttaacatgagatttgagtgaggacacagattcaaatcatgtcagtagtatactacattaatgaaattaaagaaaaaaaacacataatcatctcaactcatacagaataagcatttttaaaaatttaacacccttatatgactaaaaaaaaacaacaaactagaaataggagaaaagtacctcaacataataaatgtcatcatgtatgcaaaatgaacggtgatcattatacttaatggtcaaagactgaaaatagtttctttgagataagaaacaaggcaaggatccttccttttgaaacttgtattcaccacagtactggaagtcctagcaaaagcaattaagcaaacaaaaaaataaaatcaattcaaatggaaagaaaaataaaattatttccatttacagattatataattttatttctttaaaagcctagagtccacacacacactcagcattttagaactaataaacacattcagcaaagtactaggataaaaagtcaacacagagaaatcatatacatttgtaagtctatacaataactgtgggcaatctgaaaggaaattaagaaaataattttatttacaatagcatgaagaaggatagaatgctaagaaattaactcagtcaaatagatgaaagactcatacaatgaaaactaaaaaatatgtctgaaaaaaattaaaggacacataataaatgtaaaggcataccatgttcatgaattggaagatgtaatcttgttatgatgtcaatatgcccaacacaatctacagattcaattcaatccctatcaaaatccaaataatgtcttttttgcagatatagaaaagcctatcctagaattcgtatgaaatttcatagggcttcaagtatccgaaacatttgtaaaaaagaagaaagttggagaactcacactactgattcaaaacttactacaatgtatagaattcaaaatagtgtgacataaattaactgtgctggtacaaagacagtaatatagaccaatggaaaagaagagagagtccaaaaataaactttcgcatttatgatcaaatgaaggtgccaaatcattgaatcaggaaaggactatcttttttaaacaactgatactggaaaaactggatatccacatacacaaaaaataaactcttacctaatatcacattcaaaacttaactcagattggatcaaatatctcagcataagctctaaaactataaaacttttagaagaaaatataagtcagaagtttgaagatattggaaggaataaatgaattgaatcattttgcagtgctttcttggatatgacacaaaagacacatgaaattaaaaattgacaaattagattttatcaaaacttaaaacttttgtgcatcaagaacactatcattggagtaaaaaggcaacatgtggaatagaaaatatttccaaatcacttatctaagaagaggttaatatagaggaataaagtatacaggagttcttatatagagggattctaaaacgtaataaaaagaaagcaacctgattaattccaaaatgggcaatgaacctagatatcaaaaaatatgtaaatggccaataagttcatcaaaatagcaattcctatggaaagaagtttgatcttaatatgaagtggaaccttaggaattaaccattttcggtaggtaaacacaactgaatatagatgccttgatataattccatcgcagtaagtagcaaagtgtaagttaaagtgagctaacatttcatgcctatataatcatcaaaagtttaagtttgataataccatttactagtgagaataccatttactagtacacaatagggacatgtatatcctgccaaaggactactagtgacacaatgaccttgaggaacaaggttaatttccttgttcctcaaggttaagttccttgttcttcaaggtcaagtttgtagaacttagtcgtgttgaagaagtccatctctaaccctcagagagtgctggtgggcatttaaaatggtacagcctctttggaaaacagtctggtatctcctcaaacaattaaacagaaagttatcatatgatccagcaattccattcctaggtatatgcctaaaagttcccacaaactttgtacgcaaatgtccacagtagaattattcatagtaaccaaaaggtgaggaaaaacacaaatgtctgccaacaaatgaatggataaacaaaatgtggtatattcaaacaatgaaattattattcatacaatgaaattattcagccacaagaagaaatgaagcactgatacgtgctacagcttggatgaaccttaaaaacatgctaagtgaaaggagccagtcttctttcagaagtcaaatatgatttcatttatgtgaaagtccagaatgaggaagtttgcaggacagaaaggagattagtggttacttacagttggaaggattgagggatcagggagtgatagctaaagtatatgggacttctttttgagataatgcaaattttataaaattgactgtgataatagctgcacacatctgtgcatacaatacaaactataaatctgtaatttttaatgggtgacttgtttggtatgtgaagaataggtgtttttctaaagaaagaactggtaagtcctacaacagtaagttaggcattcagttgaaaaggcttgtggtgcaagaaggtgtgtcatttttctttttaaacaaatgtagccttataaaggtcagaattactcattgtagaacgttttgaaattgatataattaataaaaacagaaagtatacttatctataattgtatcacgaagaatggaataatttcaaaaatcaggtgaagggatttcacctttagaaggaaaaacatagtactaattagaatgaatctagaatcaagaagctcaagtccagattattttccattcttttccttactcattttttaaatttatttattattattattattttgctttgtgatttagggagagttgaaggctgtacgcttaaatttacttacattacaaatgaaagatggtcataactagttccagttttgtttaagttttaactgaggtatgtcaagtgtatcagttaaaattctccagaaaaacaaaaccaataggatatatatctccatatatatagggagagggagaaggattttaacgaattaactcatgcaactgtgagggctgacaagtttgaagtctatggagcagaccagcaggctggacaagtattaatgaattgatgtttcagtcttgagtcctaaatctgtcgggcaggttggcagttgggaaagttaggcacaatttcttgaagcagaattcatttttggggggaaacttcatattgtacccttaaggccttcagctgattggctaaggaccatccatattattgagaatattcttctacttaaaatgaattgattgtaaatgttgatcacatcgactaaatacctccacagcaacgtctagactagtgttttaccaaacaaatgggcactatggcctaaccaagttaacacaagaaattaaccatcacagtaggtatgacacttcacacagtgagaactcaagaaataatagctattattttgttcccacctgttctttcctacaaataattcacttaattcagagcctcatcatctttcacctagatattttagtagcttattttctaaaatttgttctcacatctccagtcattctaattcagccaccatccgcagaaatatatgttaaaattgaatgtacttaacagactcccacaaggttataaaatgtcattgaagtgacactcaatgtcattaatgtaactaatgtgacaactggtccatcatctgagctcctgccactccagcacagagcacatatttttctctacctgaaccaaactctttgtgatttctggatgaaagacacctgactcctctgtgtctctgagtcattcctcttggtagacctagccatttaaaaaaaaaaaatttccttcaaaagtctttgttaaatactttctctcttcttctctgataatttttttctaacccttactccatgctaagtgaatagttcgctttttgggattctggcattcctctctctcaaataatttttaatactatttatttatgttgttatcttctaccactaactgagggggaacacctagaatacaggatctattaaacattttttctctctcatttgtttttctcctcctccatttcttcctcctccttttttgtaaaatttactgtagctcaaggcaaaatgtaagtttaataaatttctggttgctttgagaaactgatgaaagacttattgttatttctgtgtaaaacaagaaaccaaaggttttgaggattgtataatatgggaaaaagtcatgtatgagaagatagatcttgtaaaggaggccatgatataccataagctattgaatctggaagcagggagctaggtgtagaggccatcattataatctggaactgcaatgataatcaaccatatatcaatataacaagcttttatgctgagatctaaaatttgattgctattcaaagataaaaattatcttataaacctaattaatgtaaatgaaatgaggcaaatattaaagaagtgtatttctaaaggtttctttttctttttacaaaaatgtcctctttgagactccttccctgaaattgctaatatttgtttaattttttatattgttgaaaaatgtaatgtttaggtaattcttcaaatacaaacaaaaattatccacatctctctatcacctgtgtttttgctattactaggaatttatcttaaaattttattaaaacctcaaattatgagcaatggtttagtttctttgggagactttaaatttgtgatataatctcttacttcattactaataacaattgtgaactatttgatcaatttttcccgagtagtatttaaggtagcacttttcaaacatatctttgaaatctcacatttcctactaaaagtcaatgagattttgcttcatattccattaaatatctatgctttttaatacaaaagtaattatttttaatctcatcaggatgtgttcaagaaatgtatgataagcatacacaaatatatttgtgtgtttgtatgcacacacacacattcacacacgttactgctggtgccaagcacgttctgggctgaaagtcttggccttagagtcctattataccagagctttaatggaagtagatgaggaacaaggccagcaattgacgaattctatttcaagttagttatttaactgtagtttgtatgatgctcatttctagttggtagaatgatgcagggaaaccactagggagtgaagccaaacaatttacactattaatatcaagtgtttgacatgatgagtgtttccaatataaataaatttggaccacttttttgttgttgtttacctcattcatcttcattagtgaagataactgaaatccgattaccttttcattttatctgaaacaaaatcgaatgttcctgcttttagttgcagggtataaaaacaatctcccttaccacattgtagtattgccccatatctaacgtctaatgggtctcaaatcaaatttgagatcaggaaaatcaataccaagcagctcatatcatttatttactaaatatttgggccagaaatagtaataaactgtaaggggataagtctgtttgggtttaatgggggggaaaaaaacaggaaacaaaacctcacctttaaattatcttaactatcttcacttataaatttgcaatgtatttaggtatatatttacatgaatatattacatatgtaaatgtaacaggaaatacaatgtcacataaataaaatgccttaacattgtgcaggtatgtgggacaaatatgcaattatgttatataatttaaaggaaaattaatttgcattgctgtgtaaaaatcacctacacatcaggtgagcaatcccacaaacttcctttaattcatatttaggcaatattttagtcatttagaaataataaggtatttgtaatgactttatcttttttctcttgttttccaatgtaaatcacaatttctgtggcacgtcttgtttcatcctgctcataacataatattaaatattaaattgtggagtaagaaccatcaaaatcatgggattgtagattttctaactgttcacctgggtcatgcataatctaatatacacaatgtatactttagacagttcctgctaaggaaactatttgaatgaaagagcaatgtagatgacagttagtgaaagttcctgaatattagactctttctgtatcattgcaactaagcgcttacaccatacctattattcttacatttgatcagacagggttaacctagagtgatatgtcaagtttcatttgatcagcagtctaaacaaaaacttaagaaaaatgataagattataatagtatctaccacaagatgtgaaccatcttacataacccctgaggttaaaagatcccaattaggcagagttcagtactttagtgatttactgtgttttattaaatggcatgcagataactccccaaagggaactgtggtctgcattaatgtcgagactcttcatgtcagaaataacttcagacatctttcaagtggtgtggtagaggagctctccgcttgctctcctccttaagaacaaccaaagaaatgaaaataaaaaaagacagtacaatttttatgttacattaatcagctacagcctaatctataatctcaacggaacatagagtaaaaagaaatccacagccagaaaaggattgaaagcaaatatacactttaatagattttgagaaacacaaagaaatagacaaactgacaattttagctggtaatttcaacatttctcttacagtaaaacatgaaaaaagtagataggaaatcagtagggtataaaaggtttgattaacactatcaaccaaattgacataatcgacttttatagaacactatatgtgataattacagaatacttgacatgtttaagtgcacacactgggccataaaacaagtatcaataaatataaaagaattgaattcataccaaattatattctatgaccataaaggaattaagtaagaaacaaacaaattttacacacacacacacacacacacacacacacacacacacacactctctccacattttttattggaatacgaatatatctaataagtaatatagtattatacatctagtgattctgaatgtagattttgtcctgtaaatatattacacatgtgtctcaagacatacattgagaaaattcattgcaacactatttataattttaaaaacaaaatagaagactgaacacaacttaaattattattatgggactagtaaaataaactatggtacataaaataataaaatagtgacttcttcagaagccattaaaattaatgattcttctatatgtgcaggaaagcagtgctatccagtgataaaagaaaggtccatattgttacttagcatgttattattacaataggtaaaacattcccccaaaacaaaaatatctatatattatttaaatatttccagaattatgaataacaagatgaaacttaaattacagaattgattacttttaacatagcatatgaaaattaaagcacatcaggaacttccaaagtaaagaaaaaggtggcaaattgttatatatatggatatagatatagatgcagatatcttattttctgaagtgtatgtcagcagcaatgatcacatacaatggcatgagattctacgtgtgttacacgtgtcaaacataatcagagacaaaatagggaaagcaatatgttaaagtaaaaataattattgttttagagtagtagaataatgttggtatggtctttaacgtttatgttattatgttacatattgttttaagtgttagaagaggaactagaatatgaggagcaagggacataaaggactagacatttaaagctgaatttaaaaagcaactgtgacttggaccttaattctacttggtaaaaaagacttgctaataatattgaagttggctattaaaagaccgtggtaagtatcttatttgtttctgatgtgctctggaatggaagtagaatgcaaagatcattatattacaaattggtactcaactcttaattctttcaaaattatcctaatcactgtttctaacatcccagaactaaactgggatatgggggtgaataatgtcaagttggctgttcatttaagaaaaacaaagcttgtccactaacttttttgatttcccttatgttattcaaattcagtatcttccaaaagagctttttttggggaaaattttcaccatcttctaaccaattttatatctctaacataaaaacctgtccctgaaagcataatgacatttgtaaacatactaataattcagatctttacacttattcttggaattagaatcaaaactagatataaaccacttcaccctttaaaattatataatttacttgacattaataaattcttcttgaaaaggaaaaataaaaatactacacctggatatgatgaagaatgtactggaaaataacctttcacttcagagcaatcacaatgaaaagaactttgactaaaattgaataaatggttttacaaccctgatatagaagagcaattgctcacacatcaatcttcacgcaaattcagcaataaactctgacaaaaccttaaaacaaaccaacacataaaaagctacccaaggactcaagcctgaacaaaaccaggcagattttcgaagggagtgaaatttacaggaaaatagctcacaaaataggattcctccattttgttagttttgtttagagttttagcctaagggcaactgtagtggaggcagagtgtgggtatcaagtaagttgaatctctgataggaaatccgactgtcgtttaggcaagaccaagagaaagagcccttgagtagctgtaactgccagagaatgagaagaatccctgagagagtcagagcaggggtaactagtggtgtgcacgtactcaggcaagtgtttgactgaacttcaactataaatgacagaattttccgacgaagtctttaaagctgctattctaactgtatttcctgaccttcataaaaataaatgcaaaaggaataaaaagataggatatatcagcatacaaatacacctatcttaaatctattgatatatttatatatcttatatatcctacctttcatagacagatacacgaagaatattaaaaagaagaaaatggacacttgtagaatttcgaaacagtatttaaaataaaaaaaaaattggatgggataaagagcagaatgaagatgagagagaacagagtctgtggcacacagatcaataaacaacatttaatctgaaaaaattaagaaatttacaaaagagagaaaaacaaaacaaaacaaacaaacaaaaaacagacccctagggacctgtaggaaaactgcaaatctctaacagatggtgcttggaatctcagaagaaaaggagagaatggagcaggaaaaatatctgaaaaaaatgatagaaattccaaaatgcaataaaaaacacaaatttacatattcaaggtgctcagtgaactccaaacacaatatattcaaggataatccctcaaaagtaaatgttagcgaaactgttgaaaactaaagataaagagaaactgtggaagtgaacagagacacaacacaacatataagtaggaccaacattagaatgcttacagacttctcattaagaaccatggggaatcaaagtgaaataaagacagtttctgactaaagaaaaataagggacccacactacaaaatatgctcttcagtgagaaagaataatatgataggggaactcggatcttcaggaatgaaagaagaacattggaaatgttaagtatatgagtaaacataaaccactaaatttcctcttaatttctgtataaaacgtattactgttaaaagcaaaaatgacagtatgggggtatgtatgtctgtatgttgtgtgacaactataacgacaaaaatggtgagggagaaagaaaattatacatttgtaacatttctatgttttacatgagattattatcttccttaataataattttcacaaggcactttgaatttttagttactgataaaaatcagattgcctgataattttagaatttaagggtatgtggtaaatgaggtagtttattttcatcaaacaataatagcatcatggattcataaacaatgttcattttttttctaacatttggattacgaatacatttgaaaagttgaaacaagtcactataaaatgccttcaaaatgattgacttaaaatttttcaacttttttctagaacattatgagcttttaaaatttgaggttattttattcttattcccaaaacctaagatgtattcgcttggtagctaatctagttttaatcatgcagttaataaaatatttattaagtaatcctgttttgttggtagcctgtgttttgttggtagcctgtgttactcccaaaggtcataaccttcaataatatagttaataaaatgtggaaaatatttccacaaagaaacaacaggacttgagtttttaaagaataagaagtttgcttttagaatctgtaatgtgttagtcactctggagaattcagttggaaaaaaatgaaagaactgaactgctgagatatttaaaatctagaagcatgaggtgataagtcaagaaatactttgggcaaaactgaaattcgtatagcacaatagcatgcagataaagctaggtgagtacatgttttttctttttctgtggggtgaggggagtgaatagtggattcgctgtcttagaaccacagtttcttaatttcaggtttgaaagttatatacattaatttgcagaaaagaaatagagaccttacaaaagaaaaaagttacttgcaaagactattagggacaatttggtaagtactgttagagaaattaaagatgagaaaaatgagggatacacataaagaatgggattgtcttggttgacctggaatgctacagtggctacgtatttgcagagattataaattgagagtcattctggattcttgtacatcataaaatggagtttaagattactctagctgttgtgttcaggatggatttattcaagaggagggtgattgtctgagatggagtccattgaaatgacctttcaatggagatttgaagtgctaatcctatataggtgtgggaatgaaaaagatgcacagttggtaaataatatgaataagagtgatttttgtggattttgattgaaacaaggcaatgtgaggaggccgagaagataaaggtatcagaaataacttcttaaagatgagtttgttcttactgctagactttgctgacattgagttgacacatatcccaaagtgttatgcaatttgaaagctgtaaaaataattggttcttaaggttacatatagtgatccatatattagttcatttttacttaagaagatatactttaaaatgcatttttaagagttttcctagaatattggacctataaaatggtctggttttttttttttttttttttttggaatcattgtctaatgcatttagcacagcagttctcaacctttttggcaccaggcactggttttgtagaagacaattttttccatggactggggcaggggagggatggttttgggagatttaagagcattacatttattgtgcacttgattactatgattataacattgtaatatgtaatgaaacaattatacaactcaccataatgcagaatcagtaggagccctgagcttgttttcctgcaactagatagtcccatctggggtaatgggagacactgacacaattagatttcataaggagcatgccacctagatagctcacatgcatggttcacaataaggttcacactcctatgagaacctcatgccaccactgatctgacaggaggcggagctcaagcaggaatgtgagcgatgggagtggctgtaagcacagatgaagcccatggttcacctcctgctgtgaagcccagttcttaacaggccacagactggtccatggcctgggggttagggacccctaatttagaaaatacaatatagtatcctagttctcaacattcgcaatgaaattagaaatagctttgaagagtcctgaattaaatatatatatatatatatatataaagaaactgtcttaattttatttaacacaatgtttcatagttgttttaccccacactagggatcagcaacttttttctgtaaagaatcatatagtaaatatatttggctttgtaagacaagagacaaaaccaaagttatgtaggtgcttctacaataagatagaaatcaaaccgctacaaaattttattgtagttattcaaaataaaataataagtacaatgttatgtaatacaagcctacaaatgaaaaaaatgaaatatgtttttgcaggttgcatgtaagtattccctgtcatcaagtccattgcaaatgttggtctacaaaaaccatttttactttgcatgctatacaaaaagaggaacagactagattctgcctatgtatcctagtgtgttgaacaccactctagaccatgaaaacaaatttttttgacatgatgcctattagaatttttttttagaaaatcactcttctacaatgaggagccaaaaagtagtaaatctgattggaatgaacctcatatgagaatgatttttttatgaagaagtagaaacgttttgatgtaaaaaaaattaaaaaaataattaaaagaaataggtagcaatgagcatcttgaggtgtgagttgataagcagcagtcatgagagagggcagctggaaattgagtcataaaggaagacctagacgtcagttatggcaaagaaggagaaggaacactcagaagagattgaattgagagtagaggtaagttggttggttatggagtgacagtttgagaatgtagagttaaaggttttggaatgctgaatggataaaaagccagggattattgaacattattatgggaatgataaattgatggaaggtcaatttttagtggcaacaggcttacaatctggggatgactggtgtgaacaggaatacatgacatgaaagatttatgtgatattgtctgtgtgaggaagggggtcactaagcctagtgtcagggagacttagttgctgtgatgatgggattcattgaagctccttgttctagaataaatgctattacaaagcatcatatttcttgaagcatgtgatgaaggattctggacaggagacttgcactgcaacctgagagactgtgcagataacttagaatctgggtgtacttcctcaattctcattatcctcctttttgtcttcctcctcctttttcccctctttggattacttttacattctcaggaatttcaagtctcttcagagagacttttatgaaagttagttcatgtcaaaccatcatctcttttaatctcttcttatcccatcatccatttataaagccagaatgtttatgcactggtgacacctgccccagaagtccactgctcattttctcctcagtcacattaaatcttttcaagagttatgatgccgagtcatcactgaagactgaatttggactttcctgtaaagtctagctgtctaaacatctgcttttctgcttctattcatttcaggttagtctattctaatgttaaagtatcacacagaaccacacccaccttccaccaaaggctgatgtgaaaaacagtccattttcactgagcacatgttgtttgtttactgtattaatacctgtaggagactcatatgggaaaggtgtttggaggttcagtttgagatatccttttaccttaattgttatattacagtaatgttgagattgttgctatcctgttcacttactgcttttccactagagcagaatgcaaagaaaataatttccagatcaattaaaaataaaacaaaagatcttaggatcatgatttttaaatgtcttgactctttatccatcattgtatctccaaaattggaccagtattgtactagccagtttttaggtggaactattcagaataatcaaagtaaacagtgaataatttttaagaaagtgtctccctcttatctctgtgcgttttccctacatctctcttgttctccaataattcttttacatttgtatcttgaccccactctttctctagcatacatgtctttgccttaacatttgcctttctttcctttgggttctttctatacacagcattttcaacatgtgtcatcttgatctgccttttctcatactagtttctctacttggaatagccctttctctgcttagaaaaatctactggatgggcgccgtggctcaagcctataatcccaacaccttgggaggccaaggcaggtggatcacgaggtcaggagttcaagacgagcctggccaagatggtgaaaccctgtctctactaaaaatatacaaaaattagccaggcatggcgacaggcgcccgtagtcccagctacttgggatgctgaggctggagaaccatttgacctgggaggcagaggtaggagtgaggcaagatcgcgccaccgcactccagcctgggagacagagcaagactctgtctcaaaaaaaaaaaaaaaaaaaaattatgaaaagccaggcgcagtggctcatgcctgtcatcccagcattttgggaggccgagggaggcggatcacctgaggtcaggagttcaagaccagcctgaccaacatggagaaactctgtctctactaaaaacacaaaattagctgggcgtggtggcacatgcctgtaatcccagctacttaggaggctgaggcaggagaatcacttgaacccaggaggtggcggttgcaatgagccgagatcgcgccaatgcactccagcctgggcaacaagagcaaaactccgtctcaaaaaaaaaaaaaaaaaaaaaaaagaaagaaaagaaaaagaaaaatctactggaacttgttggcccagctaaaataccatggctcatctgaagcctttttttgaccctcccatctctcaaccagattcagactgtttcatgacattccctcagattccaacaacactttctgcttcgctatattataaacataccataccatatttggtaatttgttagctcttccttatccttctcatgttaaattgagaattgttcagcaacaggggctgtgacttagtcgctattgtttcacagacacattaggactgcagtgaaactgtagaggaatgagtgaactgtataatcatcacgtctccgtgcatacccgcacaattgtacacatgcacacttttcttttttcttctatctttacattttctttattaatacattttaaaactatttctcccaaatagcaaatatatatttacatgtttctttaaatgatatgaaacttacaatatcatttggcattaacatttgacaaaaatgctatttttccaggaagtctacctagctgttctgaccaaggtatcttttctgttttgtgtatcaatgtcttctccaatgaacaagcaaataatacaaatacagacattgatccatatttatgcaatggcaagtgaatgcggttcactaaggcggaagctgccttttagaaggattaagagatctaatctaaaccatatactttgctggtaatttcagctgaagaatttggtttttcttctttgtggaacgtgtagtaacccagtattgttgttgtcactgaattggacaatatcaatgaaaacactagcagacagtttatgttttgttatattggaaaatgcagttagaactgaagggaggaccaacagggaataatttattgcaaacaacccaacatgaattactgagaattaggcattactctgttgaatactttttgacatgcttttcagccccaaattaaaagttattagggcatattgtgatgtagttatgtatacatcataggtagtatgtagttgtatcccattgtaacagacagattaactgaagtacgagggatagccaattctatagaatctcatagggagaaaaagactcagggaagtattctaactgccttttattgcggatcctaagttatgcttgaatttaagtgattctcatcctcagtcatcatgggttcaattacatttaagttcataagaatactaacaggagtaaattaattctggacatgggcattttggaaccaagttcgcttttctatgattattttactggtgtacattgtgtttgaagaatatagtaaaaaaaaagttggatgtttctgtattgcaaaaacaaacaaacaaacaaacactatttattcatttgtggccaaaggtgccttgaaattttatgaagtagtataaaaagtcaagctgtgggaaaaatgtgcatgggagataaccaagcctagtcccaccttctgcatttttcagtttgttttcttatcagcctgcccataaactggaaaagcattaggcacaaacccactgataagcatatgagaatttcttctagtgtccctcattcttctttatggaatctgttataagaattttggaatccccatttgaaatacaaagagttacaatacaaatgtaaaaacaaattattgtaacgtcagaggctgaaatgcatatgcaggatcccttttgttaatctttggatgaatgagagggagggacacctacctgggaagaaagagtagtaaattcagctcactaccaacagaaatgacagtgaaggactttcttaacattgaggctttgaaggttaaactgttgcatgtcactttccaattaggatgcctgggagtaagcaacagaaatagactcaggcttacttcaagagaaaatgaattcattaaaaatattactgggtgcagcacaccaacatggcacatgtatacatgtgtaacctgcacgttgtgcacatgtaccctaaaacttaaagtataataaaaaataaataaaaaataaataaataaataagaggacaggctttggagccaggctgcctgtatttgtgttaagtttcaccattacctaccagctgtgtaaacttgggcaagttacttaatgtctttgtcctcagtttcctcatctgtaaaggataattttaaccacttcttaggtttttgtgagtgcttagaagcaaccaacaaatgttagttctcaaaaaaaaaatatatatgtatgtatataagttctcagaatcaaagagaaagttggaatttcaggactggaaaatgaacaggagttaggagggcctacacgtttttgaacataggaatgtgttcaggaaaatctgatgaggttgctgcaactggaagccacgtgaatgggcatgcaccacatcacccttgctggatgctgagggtctgctgttgctcttgcgaataatttttcaattacagttttattatctcaaaattcagggtcctgggtgggggcatgacctaaggatattttatctggattttgtcttatggttaaagactgggttgtactttccactgatactcacataatacaaggatcctccaaaatagaaagggaagtcagatgtggagtagccaaataagaggaaaaaaatgtatactaggtagccggtatagagaaaatgggtgcgtggtcattaatttaccatctttaaatgcatatacttattttcagcgtaactggataaaaatgtctgattctttctaaattgtaattatatcttttatcttttctagcaaattacttactactagcttccagtaattaaaaaaaaaaaaatcaaacatctatgtacaggtacactgaccaatatccatgaactgattttggttgatttaaacctgtagacaaccatgagaagtattaatatcacatctttacaaatgagaaaacagactcagagagatgaagtaacacgattgcccaaatattacaaagagcaattgacactgtcaggatgagatctcatgtctctgtgatagaaatttcatttttctacagaaccatgaaaaaagttatctttcagataacgtagctgtcatttcattcactattgactatctctacatttcttagatctctttttttctgtatttttttctttactaaaaatcgtgcttttatttttattttctattttgagttctattgcaatcagtcatattaggcagtaacattttctcctaaattaatgccctcatccattggttttatttttccttattctccatatctgtattaatttgtgtatggttttaatgaaaagtcacattataaaataagatcttgtatttttttaatctttataacctcaaggctcagcacagggcctagcacataggaggtgcctgatacatatttgctttatgataatgggctcgaagaaggaaaataaggcatgacaatggggtggcaaaggaaaagtgaaaaaggagaaagttgggtagagaagaaaatggatatgcaatgactagataaaaccatcttctagcacttcgacccgcataaatcaacacataagggatttttaaataacagttataatattgataactgtttgtctcctgtgggttccagtttatttctcggggcctgtaaatatttttcttaatgttttcaattaccaaaatgatttattcatcacgaggtcttctcttatgctaaataagttttatgaactgacatagccaagagaaagtctgttattatattccttatattccatttattggagttggtctttttgctaacttttatctggtatccatttatctcctaaaaagcgtggattaaaagataaggctttaggactggtaagtgacttacataattatgaatttaagacaaagggacatatttcatttctttgaaaatgcataaagtgctgcaaaggttttaagaaataagaactctttgaaagggcttcctgatatgaataattgcaaatgtcaagggatgagagtttcctgatagtgattctatttctagaatgtcaggtactgatgcaaaggtgacatgagtgatttgaatgagttgttctatgtctcagagatggtcccatagagaaatgaaagcagtgctttataaccaacagagagatttatttaagaccaaaatgtcagaggtaatcaaactgtttaatttgtgctcatagttttgctttgcattatataactggacacacagaatttattgtatactgacaaattatggaaacagaattttataaaaagtaaagttgaatgctgcattgtggctttcagtaaattttgataaaagtctttatggtaatattcttaatgaagtataaatgctgatatatattctatataacatttttccttttgctttaagtttatattagcatgcatgcaacaaaatatacagaactgatcctcgtgaacacttccatgtgcatggtgccaagtgcagaaacaaaacatcgttcacactattgaaaaacctgtattctgacacctaccagtaactatttacccacaaagataatcattatcctgatttgtaacatcgttattggctatcacaaatagcattaccaagaacatttttgtatgcgtcttttgatacagaaatctatctatctacccatataagtttctgttaggtatataccttagagtggagttgctgagtcagacctatgctcagctttggtaagaactgtcaaaaggattgacaaattgattgtaccaatttattctcccaccagcagtgcacgagggttccaattgcttcacatccttggcaacacttattagtggctctctttttcattttagccattctaattataataccaaaatattttgtgtgtgtgtttgcttatatatactcctactaccaaaagaatgtaagtgacataaatcaaaataagcacttttcatttatcaatttatacatcaagattttaaagagtaattcctccagatggtttctagactaaaatgcagcatattgcttagaggaggaaacttttcttcaatattcgatgatccatctaaaaatatgtcttaaatatttcaaaaatttatatttattaaacaaatataaaggttttgcaacagcttatgtagatgatggaattcaaggtgtcttattcttacaatatctctgataaaaaataactgtaaatgtacttatatgttttaatatggtctatatgataatacttttttatttattgaaataaaatatagcatgttggaggtttctatgtgaaatagaaacctaatagtgattctgtttcactgaagaatttccatgtgtctcatttatttccaaaacaatattacatcaaattaaaagacaaatatttagtttattctaagatgtgttcttaaagacattgataaactggcatgactaaaaaattaaatgaaatcaaatttttacctcataaaacaaaaggtctaaggttccagataaattttgaagccagtgttttgtcaggggccatggtaaggctggaatttgggtggtgggccgggagccaaaaagagctgaggatatggttgctggaatgttcaagttctattaggcagggaagaaggtgagaacttcataggctttgaaagatatgcaaccagtgctaaaaagagccgcagtgattgactctggaaggtgaagcttaggattcaagtgggagatactaaaacattggcattggaattcacaaacattttaggcatgtacatttaagacatatgttaggaatcatgactccattttgccaattataattcctgttaggcagaatatctgaatcattcttctgccagcagtcccccatgtccatcacctattctgtaactatcaccaattattttccccaatattttcctaaagctgattaaacactcttgggtcataagaaatttacatttgtcaataactgaaaaaagttggttcaaactatgtgatctagccttcaagctgccctatggttttgtacaaatttaacctttagagcaaccatatcatcatatgtatattatcacaaaaattaatgttggtactttattcataaacatgtataatttacatacataaacttgtataagtcatgtacaacaataaatatagtgactaatcatcagggaaatgcaaatcaaaactacaatgagataccacttcacacctgtcaagacagctattataaaaaaaaaagtgttggtaaaaatgtggagaaattggaactctcatacactgttcagtatacaaaataatccaggtactatacgaagacagcatgaaagttcctcagtaaattaaaaataaaactaccttatgatctagccgtgccagttctgggtatttattcaaaataattgaaattggaatctcaaagagttattagcactcctatgttcattgcagccctattcacaatagccaggatgtagaaacagtctcaatgtccatcaacagataaatggttaatgtgccatatacatgcaatggaatactatgcaggttttaaaaagaaggaaattgtgcaatatgcaacaacacaaatgaaccttgaagacattaggctaagtgaaataagccaggcacagaaagacaaatactgcatgattccccttttatggggaatcaaaaatagtcaaatacatagattttaagagtgaaatggtgattgcaaggggctgagggagaagggaaaatgggaagttactaatcaaccgacacagaatttcagttgagtgagattagtaagctctagagatcagctggacaacattatacctacagtcaatgataattcattgtacgcttacagatttaagagggtagatttcctgttgtgttcttatcacacaatttttttaactctttgcaatattttcctagccttttctgcttgactacctgctttccacttctgtaccccactgtacctcctcccatattaaaaggcaaacacagatccttccatagtctcttcatgcttttgtgtatttgtaaaatagagtcatgtatcacttgatggggatatgttctgagaaacgtgtcgttacgcaattttgtcgttgtgcaaacatcatagggtatatctatacacacctattttgtatagcctactaggaataggctatatggtacagtttattggtcctaagctacaaacctctaaagcatgttactatattgaatattgtgggcaactgcaacacaacggtatgtatctttgtatcaaacatatagacacgtagaaaagacacagaaaaaatagaatattaaaatctcatggaccacccttatgtatgtggtctgttaccgaccaaaacattgtaatgcagtgcatggctatattgtacaagcaactatagtcatccatttttgtactgtttcagtaaaggtttccaaatgggaaaacagatattactctagtggtccagatagaagagatttaatacagataattgttacaaacagtgtcgtaaaggctggaggggccaaagtggtggtatgcagaacctgtaaacacatgttgccgttatcaaggcaggaccccgggcttacactcccgtcaccactgccactgaggtcctattgctgaggctggtgtgccagagccactgccagaggcttccggtttctgactggtagagctctcctttttttgcagaaagtaactagaagtcaactagcaaagaagctgagaagactattttgaaaggaagtcttagaaatgtaaatttcaggctttctaaccacccccagtaataaaaaaccatataggggcagcagcgggactgacgaccaacagacaacctccaatgtttatgtgtcggcgagattactgatagtataaatttatgttagtattgtcattgtctggtatacaaagatgggcttccgtcgaattctttgttgtttttgcttttctttggttttctctcttgcttttgtcacttgacgatatctcagtgaaatttttccaagtcaactttattcttttccaagcacaaatttattctcttcaagtcatgaatgttattatatggtgtggatgaatagtaatccatccaggcattcgattatgatgagttttcatcttgactctgacaattacgaagagttttcactttgactcttctttttagttgaaataaacatcactgctcattgctctctgcaggttggtgtattttgttgttgttgttgttgttttttgtttttttttttttttacacggctaggtcccaggtttaggattgctggtgagatggaatatgttttgtttgcaattgccattttatattcccaaatgggaataacacattataatttcacaactaaattagaaaaggacagttttcactgcatccctgccaccaataggcattatctgggatactttcttaattacaattttatttcccagaaagcaagccatggtggaatgaatgcaaatactatcccaactccagtgtaactttacagatctttccaaaccattataatgcatggagatttttgaatcattcaccattttcaaatttaaaattgtcatgaaaattactcaaatcagtgaaggcagaatagcgtttcagtaatatttcagctaaaacaagtctaatgtttaattatgtatcttttattttgtgtttttattttcttttaagatggctaaaattttgtgagagtgctgctattgtaggtttgtatctgccattgtcgcaggttgaatcacttatggtaagctaatttatattgtaactgcattccaactcaagatcttcatagactttaatatcaaattttcatttcttgccacatgttcatcacaagttgtatgtcagtgtggagagaatctgcctaatggctcttcacccagaaatccaggctgctaggtgtccagcatctggtgaatttgctggtagttgtggcagaagagaaggtggcaaattaaaaattgactcttaaagacttctgcccagcagtgatgtatattgggtccaatcatttgttaatgagcaacattgactaacacattgattcgaatatcccttgaaacatttatgacatatttcctaacttgacataatgcagcacatagtatttcaattgttcttctatttttttttgtggtgactttacccattttgaattattttatgggtagagtaagaccattgattttgaaaaactggaagttgactggctctgcaaattgaagagttagctggtaaaatagctttccctttttatttgttgtgctgcttaggtgttgtgtttgttcttgcattgctatagagaaacacctgagactgggtaatttataaagaaaagaggtttaagtgattcaaggttctgcaggttgtgcaagcatggcatacacatctgctcggcttctgggaaggcctcactggtgtttactcatggcagaaggtaaagcaggagcaggcatatcacatggctagagaagcagtaagacagagtggggtggtgggatgccacacactttcgaacagccagatctcacacgaacccactcatattgtgaggacggcacccagctgtgagggatgcatgcccatgacctaaacacctcccaccaggcctcatctccaacactagggattacatctcaaaatgagatttggcagggacatagatctaaaccatatcaggcgactcactgaagaaaataatagtataaaatattatggcagtttaatcaataacattaggataaatagcattagtgtgtgtcatattttcattgtgattaaatctaaatgcagcccttgatcattgtcattggggtccagtttaatttcctcagagtgctcagacagtacctggggatacttgcagctctcaaattgttactaatggttagagttttcaattatttttgaaacaaatacaactcaaggataaactttgataattgaaaagggattaggatgttaaaaatgcacactttcatgaagacagctacttattttttatccactgaagaaaacatcttatggacattctctcatattacagctttcagtggcatggcattagaattctgattccatattgcttgttcttctacattgaagcagatgtcagtttcatatggattctgagtatccagtctgtcaaatataaatgtaattactggtcaatagttttggataatttttacatctgttgaagttgtggaggttttattaattattttgacttagattttattcccttcagaaagctgagaattcagaaccatattactttgggtgaggtcacctccactcctaataagagcaatatgtgctgagtagtcccggtgtgcatgatctgtgctgttatgactcacaagtcccactagaagtttcaggtacaggaaaggaatttcctccaaataaggaaaacgttgtgcacctgtgttgtatactgtttgtgaaaagcaagaggatgtagtattggaaaggtgtaaagcttatgctttagttggctagaacaaagttcatattttttctcagttatcaggggtcgtgaaagtcattaaatccaacttctatccagtgttagggaatctgagaggtaattctcaaacttttgcctaagtgtgatccacataattttagtaataagcttatttcctatttcattgtctcacctgagaactttctaactgaggtggaagcaataaatattatttgttaatagctctctcctcctccatgtcccttgccttcctactattaatactaccactattgctgctactgttctgctcctactcctaatacatatttaactaatataacatgtactctaccagacaaaacgttgggataatttacatatcagctaaagctgtagaggcttcattttgacttagagtttgttgcctccaacactcttaacattgtgaaccaggttatcttgtgtacagtccaccctgcttttagtaataccccaatgtgctatttattctgcattcatcatctcatttactcttcaccacagatctgtaaggtatgtgtgagccttattcacattttataaagtagaggaccgagatttagaaaggttaagaatgttatcaaggtcattaggattttaaatttaggctgcctggctataaagtccacgcttgtaaccaccctgcagtaccctcctttcattgtttttatttatttttaaattcttactctgatattgagattctcacctgtggtataaaaaagatcctgttgtagcggtggaattaataattaaatacacccacctgtaaatgcttgttaaatcaccagaattaaaatagaatatccatgaaatgttctagatgttcaaattgctcttgtcactgtgcacaccaagatttaaaacctagggcctcgtaagtattcagacaattgtcttggaagatcttgtgttttctctatttgctactgtgtgttaattctataccatgctaggatacaggggccctatgccatctttcaccttcttagtagaatgtttgatctaaatagcaatttggcttgccctggacaatgttgtgcttcccctaaccaaagaaacatggttctctggaagattatagtaccacattggtcagcagtttcaagtatttggcattgaagacattgtaaagcgaattataaataattttatcctgaattatctatatcataggcacattgtgacattgtttagtttgcaccattgttcctgttgttggggctattgttgatattattttggcagactgtgctatgttcaaattaagactctctctggaactctcagttataaggttattattattgccgtactatttacaaaagagttgccaagactggtgcactggaagctgtgttccacttatcaattcaaaggaattttagtatcgtttctaccatcagggaatctgtgagctgagctagatagaatcagagagattatctagagattattttattgatcaccaaatgcatttttgtaaaagtaaagaccccaaattgaagctcttcaaacagtcagttggtgttactaaaatggcttatagttacagttatcagtctcttgagtaagcaaaatgttatctcaaagccaaaacaattttgtggtatggagagagattattaagtagttgaaatattgttgctgaaaatatggatttaaaagcatcaataccaagtgccatggaatttccaaatgacaacttgatattgatacaataaaacagaaaaagccattaataattgaaagcaataaaaacatatgccttgaataaaaacaacttgaagcccgtaaataatacaacatggctattcagtgatcattctgtaatattaaagtttcaaaaggcatcctaacgtgttggattttttgtttgtttcacatttcctgatccagatttatatttttgaaaataatatctactatcaacctgatataaagagcagttcattgcgactgacatcttctggaaaagaagaaataatttttaatgggattgctgactggttatatgaaggtgagttgatcagatttagtttcaaaggaaacaaatgacatatttttatacaaaatctaccaaaaaaaatctattcattccggagcaatacttacagtacagtttcttctcattttctctcaaaattgccctcatgctttcatatctttgcatgtgcttatattttgtgtggttgagatttacatctacttacatgattccatgtttggtgtatatatgtacatataggctagatagatattatttgtgaggacaactaatgaaagtaaatggttaccttatgtcactttggaattagatgctgaattttttctgactctctgggaaagaagaaacagaaacctttatttctaaaaaaaaaaaaaaaaaatgcataaaaagccacctgattttagttatttccattagggacattctgtcacactttataagctattgcagagggagcaaaataaaacccacataaagagttattttcaatatctattgaatcaagttttagtaatagctgagaatataaaaataaatcaggtgatgaaaatttatccagtttttatcacgtaccaattatcagctgagttctacatatagattgcctgggcaagactcaaagtatgagtttattacctatgtttcagattcttcagctgattttggcaaaatatgtcaagatttaaagtaagtctactttattataaattataaagctatgaatcattcaaaaagtgaattttatttcatgggcaatatttgcaaatgtaatctctctacctcagatttgacatttttaattctataagaaaagtgaataacttagaccaattattcattcattcactctttcactcaaatgatatcattgaaggcctactgtattctggatagatgtctaggtgccaggataaaagacggagcaaaaagtactgctctaataaaccgtatatttacgtgaaatattttgttaggtggagctattttattaaagaagagatgttgtaacccttgagatttatatgtatatgtgtacatgtatatttatatctataatagatttctgtgtacatgccagcatgaaataagatttttagaggctacaatttattgtgaagagcagtgagagcttccccgaaaatattaacaataagtatgctgtgaaagtatatattagaaaaagaaatacacaggtaaggagtgttcattggttgagagttacagaatctaaatctggcttttctatttcaaagagatacattactggaggggactgggatggccctcagaatttaataaacaggtggacaacacatttaaaatctggttagttctggcagtctaggtagcaggagctaattgaagtgcagagactaagacgtgccctttttcttcaaaatattattggtactgtgtgacaccctgacagatgaagaaaccatgttaatgcagtgtggtaagtagttgaatcttaatcaacacagaattctatggaagaacaaaggaatgataccattctagggatttgcaagcattttttctaaaggagaaaccctggccaacaacagtagctcaagcctgtaatctcagagctgtgggaggccaaggtgggagaattatccaaagccaggagttccataccagcctagacaaaatagcaaggttttcatttctactaaaaaatttttaaaaattagccagatgtgatggcatgcacctgtgttcccagctgaagtgagaggattgttaatgagagaggattgcttgagctcgggagttgaagactgcaatgagctatgatccaggcccctgaactccagcttaggcaacagagtgagatccttacctcttaaaacaagggagagagagaaaaagagagagagagagaagagagagagagcatctgagtcaagcctgaacagttaacaagtgttacgcatgagaagaaattaggaaggaaaaatctaagcagatgtaacaatttgcaaaaacccacaagtgtgtccctagggaaccaaagtctccttgatataattgggccataaaatttgagacaaaggaaggtagcaagaagcgagggatagtgacctctatcaatgatttggaatttcaattattttcctaccatttaataggaaaactaatagaagttttcaagtaagggagtgacaagattggatcttccatatgaacagattgtttttgtgacagcaggaacctggggtctaagagtggaaagaaacggtgagcggctgtaaggcttcttctatgttctatcaagagataatgagcaatggaactagggttaaagcagtaaaaaggaggaaagactctaaaattgatgagacaatgaaatatataggtcttagtggctaagcagatggggtgaatgataagaagtcaaggatgattctgtgtcttctggtttgggtcactagtaagtagtggtggcagacatagtgagcaagcattaacaaggagcagtgggtttcagggaagagaagactagattagcagcaatgcgggcattgaaccacgtactgacgtgctcccttggtgataaaaggtggtctgtaacgtcgatgaagttttcagtcaactgagggtatactcaatgtagaccatgcttattgtgctgctccgtcccgaattaagatgacttgggtctctgtcctattgaaaaggcttcatacatttataaggaaattttaaggagagaaattagagaccgtttcctgacaaatacggtaattttcttaactaaagaataaaaatctatgtattcggtctgagagtaaactgtttgtaggggttgtggagagcagaacaaacgggtaatacaaacttttgtgatgatgctgtaggtctgacgcattccaaaggggaaaggaaaaagtatagtttttgccatactttgggctcctatgttgccgttaactaggaaatgctgtacgtgtatgtgatttaatcatcaaaatgtttgtgcatctaatcatttatgaagaaactaagacgcacccagtgctgtggctcatgccagcaatcctagcactttgagggggcgaggtgggcagatcacttgagcccaggatttcaagaccagcctgggcaatatggcaaaatcctgtctctactaaaaatacaaaaaaaggctgggtgtggtggctcatacctgtaatcccagcattttgggaggccaaggccggtggatcatgaggtcaggagattgagaccatcctggccaacatggtgaaaccccgtctctactaaaaatacaaaaattagctgggcatgctggtgcgtacctgtaatcccagctactcgggaggctgaggcaggaaaatcgcttgaaccagggagttggaggttgcagagccaagatcatgccactgcactccagcctggtgacagagcaagactctgtctcaaaaaaaaaaaaaatttaactgggtggggtggtggggtagcacatacctgtgttcccccctactctggaagctgaggtgggaggatcacctaagccaggaagttgaggctgcagtgagccaagatcatgccactgcactccagcctgggcaacagaagcgagaccctgtctcaaaagaaaaaatttaaaaaagaaaccaagactcagagaggatcagtgatttagacatggcctcagagctaatgagtgggagagccaacatttgaatgtgtgtcttttgttcctaaagccagggcttagtcactagtctactctacttgttatagggggatgtccttcactgttccccaagacacaacacacgttttgggacctaaattgtcagacttcagtgatctgtttcctcagccaaagactcatcctactgtccatggacttactctaatcctcactgcatttccaggaggaaccctacccatgacttcaatgttaaggtttggcagagggatgtaagctattcagatgtttttgattttccctcactattttgactgctacccccaacctctgcttcaagagtcctacatgcaccttaccctcccactatcaccttgcttgtggaatgtgccaggagctcccaagctccagaccttttttttcccctttaatgcactcactgaaacacaatgatattgcctagggaatgcatgtaatttcaacgttatgtgtgtgatactctggtgtggagatttcctttttattactttacaggagtcaattacaatctaaattagcatgtatgggagacacagaaagtaacatgtaacatttcaacttttttaaaattgaaatttaccttttgtaaatgtcatagaaaaaaaagatgagagaaagagtgacataaaagacaataaaatatttttacagtaagctttacaggcatgtcttaatcttttaagaccaggccaatctgtaagagtggctgctgcccccaactagtcactaaatagagtccttaaaagtgtcagttttaagaatctttgtctctatttttagtattgtttagttcctaaagaaagtaaagcaatataaagtataatgcattttaaacagcgaagtcagaaaaataagaaaatgctcaaaaaggaagattatttaaaatgtaattcgcacaaaacacgtataatgttattcacttaaattgctgtatttaacctagcaatgtaattaaatacgatatcagatcaaagttttactttaaaaacttttaaaatgttactaaaaagaaagtttacagctacccacttcacagctttgaaaatttccataaagcatttaatctattaaataggaaaaaaaatgactcactttcaaatatttaagcatatagaataatggaactaatatgcttaagtgatttacagatatattttagaaccttgtatatttaagggattattccttaaagtttaatccaacagctgtggagcaaatatacctgccaggcattatctaagagcaatacgatgagaaatacgggtttccatgtcttgggtatttccaacttagtgtagtgataaacaataaacaactattgtattgggaaccatttggagcatagtaaatataaatataaataggatttatttcacatactaaatagaattataagtagaactaagtttgataggatggaggaatgtcaggtgcttcatagatgacatgggccttgtgttggtattcaagaatgacaagaatgaaaaggtgcggaaaaattcacgagataagcaatattcttatcagcagattctgattgttacactttttttgttgaaataaaacagggcaaaatgcctattttcaccttcatgtttgtttcacattaatgtttcacattaatgtcttttggcgacatgaaattgcattcatttcatcattgattcaacaaatatttattgagcacttgctcagtgtcatctatggggctgcagcatgggagtcacaggaaggcagggttatcagtagtgctgagtctccagaggtcaaacaagggaaggattccaaagcttttgttggatttgctcatagatcatcgatggccttgacaggagtaaaatcagttaattggtggggccaaatccaagactgcagtggatggacatgtaaatggggagtgagaaagttatgaatagagactattctttcaaggaatttgacagtgaaatgcagaaaattgaaaaaaaaaaaaaaatcaaccacaggcctgcagagctgcaagtagcatcctcaggaaatcctactggtctgaactgacaaactaaaaatggaaaaaatcagcttgctttttacaataacacattaatctaaacacaatcgttgtatctcagtattgtggaagtgctttgtgttgtggctatgtttttaagtgcctgtgatataaaaccacatgtgctgaaaactccatctgctctgcagtgagattttctaaatcagagtaataaaaacgatgaagagccaaacgtacactaaattggaatgaaatgccatttgtaaaaataaattctttgtaaataatataatataattaacattggaagtttcaatccatgagtaaatgtgcccattagttgcagttaaagaagcttgtgccttatccaggatgactgttaagcaaatgcatattaaagattattttatttaccaccttcccattccaggtagctttatctttccatctgaagaaagtcacaaggctctctatatgattattttggtacattagcatttttatggggaagaacattaatcatatgtcactctaaaataaatgagagtaggcgatgcctcatttctcttgaaaagcgtactcaaatttgggtcaggtttattcttgggaagtactggacacacatatttcagcacctacgacagaacctgtttcttagaaatctagagtattgattttagccaacggggtatctttgtatcttcaaatctcatagaacttagagtttacggtggggccgggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaaaaaaaaaaaaaaaaaagaacttagagtttacactcaattggcccttagcatgcatatatatacacacacacgtatatgtatatttttttctgaatgtgtcatgtgtataactcatgtctccttaaccaaattgtaagttagttgcataaatcagtgtcaatatcacaactgaagaaaggtggcacgttcaaaagggagtaattcaaggagtttaagctatgaaggggccccttatcatgaacaaggtaaatgccacaaccgtggcttgtaatgatttagccattaacagccaaagggggaaggggacacagcagtcacctgaaactaggagagaatgctatacaatttttacagaaatagaagcagtggcttttggttgggcgaagccaaactcacataatttggatgcatgggagataagaaaataaattccacgcacccacttcctcccttcatttgattcgccagggtttcatagtggtcatacccaagaaaaagtcaaagaacataagaatattcttattattcaaattaaaagctagtgtcccaggaaaagaagtacataaaatctcatctgctattgtttcattgcaggatggtattagtcctgttatatatctgaaatctgtaaacatagccaccacttgtatttttcatagaaggttgtggagaaatgcccccattaataataataataaaaacttattatgtgatcttagttagtaattacagttgccttcttccaatgttcatttcttttacttttactttctgtcaggatgctacagaggttatttaacaggtggatcaggccaaaatttcattcctgccaaatgttactcctttccatccttttctatttttttttttctttgacagagtcttgctctgttgcccaagctggagtgcagtggcacgatcccggctcactgcaaactccagctcccaggttcaagagattctcctgccccagccacctgagtaactggcattacaggtgcccaccacgcccagctaattttttttttttttttttttttttttttagtagagatgcggtttcgctatgttggccaggctggtctctaacccctgacttcaggtgatccgcccacctcggcctcccaaagtgttgtgattacaggtgtgagccactgcacttggccccatccttttgttaattatgttgttacaatttcagttttccatcgaccagtactattgggcaaaaatgtatttgtgactctcctgagttccaaatgtatttctccttgccctcctttgcacagcaaacatatttttatttctggcagatgaggaccatcatcagacccagcttagtaactgtgttttgtctttttttgggggagttgcataatgagcccacaatggtggggagaaaatttccgtttccaattcagaggaatagaattatgactatattcctggtggataccctcgtcctttaggcaatggacttctaaactcaccaacttcaatattatgggaataagaagcaaattgtgttctgtgggttattgctgtgataataaaagataacactactacttctaccccttagtgcctagatctgtacctcatggctatacaggtggggcacactgcatgttaaaggatgacatcccggcttcaaggttattgctaaacaaatagtgccaaaactgaggtagagcagactattttactcctctatcaatccaagtacatatagctagtggggaacatgataaaattagtaaataccaccactgagcccatggtgcttttttgccacaaaatatttccttttttgagataaggtaatgtggattattatggtaatggataaatgtttctgtaaagagtagtgctgaacagatccattggcagcaaaagcaaatccatgcccagaatatgtgtgtatctctgtgatgacaaaatgctacactgtcttgatggaaaggttttcatataattcatgtgccttcctcattacattatctcaaaaaaggaaatattttgtggcaaaaaattcacgtgccatcagctcttcccctgagaagtgatcctatgtcaaaggctcagcgatggccactaccattggcaggtaatggtgggagccagaggctgacggacatgtacttggcagtcatcttgtcctaaatttttcccctttctagtaagtcgattcacttgtttttcctaaacctccctgtcactagttttctaattttacttttgccacatccctgataggtggacccttattagttactgcacttgagtcaggatgtttccatgcctgaaactaagtctcctaccacgaacagtggacaacgaagtattctgttcaaaatcttaccaactgggaagatttctgtttcttattgtctttcagtgccactcctgagtcagattctagtatggagcctacccaattccagctcgttgttgtacatcctgcagacctgccataaaccaggcccgcgtttatttctcccttgccaacttgtgttagaaaacatgctttgtggcacagatgtgagatgaggagaggggatgaagcagagaaggcaatacaatgggcaatcacatttgttttctggctcaatttcacttttattttatagtggaatggtgtgtgtgtgttcagttctatggtcagtggatcagatagccatcagttcatgatgggcagtttgggttgcatactcacttggtatcccatggtgaggctaaatgtttctcctggagccctggaaagagctgcccttgaaatagataatatttttcagtacaagcgacaatgatcttttttcaaatcttgtaatgcctgtcctatgattgtcatatggagagtcccaaaggctccacacagcatctctatttgccatgggcactgacattgccattggatctgctggagtcacaaggttcaggacatagaggaggttgcaacatggcctagatcagttgcaaggccccctggtacactgattctactcagaactagcagttttacagcttgcctgggatatagaacagagaacatatgtcaatgcggcttgtgttgttttcaaagtccaaagaattcaattcctctttacttttacataagtacaattgtaacaaattttctctgactttagaagagatatcccggtgtatcccaaactactagatttctagaaacatccccggtgttgcacacttttaaattttaaagaaatttgtctccctttctctacctctatgcagaggagttctagttccctaggatagcggttgcctctgtcagcaagaagatttgtcagaattttgatgttcaatatcttcagccataaaattaaccacatacagcagcattcaaccataatgtgttatttataagattggccaagaaatcataactatactgtatgcttttgtccaaacattcttatcctgtgtgttggggtcccaatccatcgttatgaatatctttgtcttaccctaaaagagcaaatggagttgagcctctaatatgtattgcagccgtgtacccgttcctatgttctcttggactgtggccatagtttccctgcaactacagaagagatggactcttccaaagataccatcgtgacctttggttttgcatgggcattcctgatttcacaatcatggtttcaagctttcttttttcctgtgtactatctgtggggtgtcagaagaaccatgcgaacttgtttcctaatctttacatcatcattgttgtagcaagtaagtgctacaacacttacttgctataactagagatgctgtgtggagcctttgccactctccatatgacaatcataggacaggcattacaagatttgaaaaaagaccattgtcacttgtattgaaaaatattacctatttcaacaagcatttgttctcccaatgccttttccctctacctgtattttattccatgtcaccaccactgatgattgattactcacagttccgtctcttgctatggattgtctatgctccaattcccacttgagaaggtgataaattccatttgtatatatagatagagagatgacaaatgtagtctcaacatctaattttgagggtctcttctgagtctgctgctattattaacttctgtatctgtcagagtcccaagtgttggcacattcaacaagatgctttgaagataattgatttacaaagtgaacattttattgtctttttatttacaaggagaacatttgctgaggttaaggggtaggaaaaccacaaaggaaagtgatgtaaactaagctagtagcagccaagttgttagcactcctatgaccatgaagatgagccattactagacacataaggagaaatttgtgtagaggtggctgcagtgacagaagtagtgacatcatttaaagttcacagccagcctgaggtaacattgtaggatagagccaagagaataaataacctgactttactctcctctttctaatctcctgccaaagggaagccagaggacatgggggccattttgatgtcgttcatataggttagctttctggaccagaaagcgggaatcaaaaaagtggatagtggatcttgaattaaatgaaagatacccagtatacttcttattccattttcttagagcttaaaatagtttgatgaatctagtgggccctcagtttggttgatgatggtagaatgcaaatatgattacatgcaaatgtgaatgaatcatgacatggatatggttttaggccacatctcactcttcaatcaccgttctcattctgattactccagtagtgctttcatctgttctgtctacattgctgaaaatccatgaaatcctgacttaggtgcttcattgtttccttcctctacagctgcttgctcttcctggaattaaaagggtgactcagaattagagaattttcagggaagttaataaaattcaatacacagtctagaaaatataggtgtacaatggagatttcaaggacagatgtttgtgggtcactgagcccacatctctacagttggtctcaaataacactcatttattctagaggaactcctgcattctcacatcgcccactggtggtcaccagatggagaaagacttgccttcctgatgataaatgactctttggtacccaccatggttatccctcggtttactggagcgttgtatcccaaaggaaagcagtatccgtatcctaaggtaagtaacatggaagtactattttgttccttctctctctctgcactagtgacttgacagatggtattcttggttcttgaacaagttgtctttggaggaaaacagaagttttccttacttgtcagactcatcactttcgatctcccagtagtctatacacagtgcttgggtagagagaggtagagatgatttgaaagtgtgtgaactttcacttttgttgcatttctttccttttgatgctcacttttattttttcacaccttacagttgaaaggggagagagaagcaattgggggtgtactgaggccagggcaatgttttgtccaaggcctattccataataggtgttacaaaggaggggaaagtgccatggtcaaatacattggaagttcttaaaaaaaaatctagcttctttcagatgatttcttagagcacttaatgtgctatatgttaatgtatattataaatcttctataaaaaatagactatgcataaagaatctccagtctgaaatagattaagcataaagaatctcaataaagaaaggaccaagtataaaaaaatcacccataaagaatagactaagcagaaagcatttattagtattagtatcaatatcagcattaccttggcagagcatactctagaacacactatataaaatgctggtatggagtcatagccatggttaggtaagacagatggaatttttcatcaggtgaagaaatatggcaatatgttccagacagcaaaactattttcaagtgttgggcaaggcctctataagagggttgcaaaaacatctggattgtactgttttttcctctgtatgccatctttaattgctcgagatctcttttaaacatgtattttttcccaatgtttatataacaaagaagaaggctcatgtgtaaggcccccagtatattaatcatgtaaagaagtcttatgggaaacgtgtaaaatttctcttctcattttagctcctaattaagtaagagaggatgttgatctcatttagaagccatttttaagccatttctttagtgagttgtactttgtctttttcaagcacaataggttttctgccgtttaattcatgcactacattagttagacaaactactgggtaggttcccatcaccctcattactctagccctgtcagggtgggggtgaggtcatttacactttccttctgttcccaccagccaccatattcattttatccaaaggcaaaaaaaggaggcttgaatattgaggatcagaaataaaatgagcatattcctcagtgagatttctcatccatgttccttccacaggttgtagtattaaatgcaagattataaagagtatgattccatgattttaaaatgtgatttatagggtcttctctggacatagattagaaagcagatatactcagtgctttttaggagaacataatgatttaacttcacaaaaaaaaaatactaagagatttttattgtactcaaagaaaagaacttctgctttctccaattatagatttagctttttttttttttggcatgacagtttggacctatacagcataccagcactattttttcccccagagaaaacctgaaaagttgccccaaatatattaattctcacattgtttgatttatgataataaatgttcacctgacaatttaaatgtgaaatggagaactagtgacatactgtgaaaggcacattcaactgttcagtgcactgcacaaagggaatacaatcacatctgactgctcaacgcactgcacaaagaaaattcagtcagttctgtggaagggacaactgtttgtaactgatttcccaaaagaaatgggatttttttttattcacatagtaaaaccaaatgcattgctgcatgctcaaattgccttcttagttctagactcatggtgcttgaacttggccatgcctaggcctcataattttgactagattgagacaaacaaacaaaccaatgggagcatttgaggaaattaaattatgtcagcaataattcagaagatactggatatgaacctagatactttatcatttgataatgtcttctaataaattaatattgcttaatagtaaagataggcgtaacataataatctttgtttattaattgtagaaatcacaggtactaatgataaactttatgttttcagggagactttccacttgtttgtttttttcttatttggtctttatcacaattgtctcaattttacaaatgagcaaatagattctgaaaggcttagtgcttttatacaagtcacagttattttaagaacagggaaaaaactcaaatctattgatttcatccctctctataaaactcccacaggtcaacaatttgtatttccaaaaacacagctggaatccaaacatctccttgtcaagttaacatatacatatggagctctgtttgctccatttactcctaatgacttagctacatgtgggtgccattcttagcctcaaacctgtcattttatatatatgcaaataatatgtataactatatatgataactaccattaatatttattagaagtaaaaaacatatgcctctaataggcaaagccaaaagaaagaatttccagtcctcaggtgatttttagtaggaagacctgctcacctacccaggtacttaagacaataggactctaagaaaataatctgttttggtccttgttcttaaaacaaatttcagtatcattttgggtatgttacgtcaattttcagattttttattatctactctggtttcaaaaaatgttttgttagtttttgctgtaacaaatgtattgtttcaattcactcttatgtgataaactttcaaaaagtgccactttggaaactgaaacaacacatagagtttatactaaattgtgctttaaattaaactagatgaaaatgagtatagcaaatacctaatgtggtcagatttactaatgaaatacagtaaacaaatatatttgtattttacttaattcagcatgattcagaactcataaaataccctatcattagcaattcagcacaaaacagatgcacggttctatcccagtaacctcaggttaatctttgtaattaaaacattatcttgtttaatgacaatctagttgccagtaaaataaggttaattgttattgaggcttgtgtttcagaataatagaggggagaaatttgtggatttgcagtcttcatggcaaatgtaactgtaaaaagcaaatagatgaaaaccctccaatctgcaaactcttgaaattattcaaatattaaaatttacaaatgaacttgcgatgtgtgcttaatttcaaaactccatggaaagatacaaatctgtgattagagaatgctggactgttgaattttggaggcagcctaacgcttagttgagatgttcacgttttgtctgaaaactggccacattgtgtgcacaatttttactttgtgataagcttatagcgctgctgacataaagaaaactgccttaaagatgataactgatacgtctttaagaaagtatgccataaaactgtgcatcattggtaagaattcacagaaagatctaatttaatttaatttcccgcttgctttaatcagtgtatctaatgataaaaaatagaagcacagcttttcactaactggaagatttaatgtcttaacaataattatcattttaattcactaccatatactattttaggcactttacataaatctttttattagtttatgagatattcttatctacagacaggaaaccttcaactcaaaatttctgatttgtgacatattctcaaagaagtgtttgtctcatttttgacaaaataagacaaataaaatgatacttgagaatctttagcatgtgctcataaccatgccaagtaaataacagactgaacatttggactcaggtttcatggacttacacattaagctaagcctgttctcgaaatgtggtcctttcaccagcatcatagggcatcagcttcatgctggaggtggactgccttcagcagtcagtagcttaagaagcccctcaggacctctgaatgattgcgatgctgtctaacttttgaccaccactgagctgttacatagatagatgcataaatagataaagatacagataaaggtcaatgttttattaaaatttgcacactcactatctgggaattttgtaaaaacagatttgtaggcccacactgagagattctaattccaagtctgaatataggtttcaggtggggtccatgaatgcgttgctcaggttccaggagatgctgattgatgctacggtccaagaacaacactttgaatggcactgccaatactgtgtcaggctgtaaagttcaacatacgagacccagctagagaaatggtaggctggtaggctaaaaattgaatagattaaggccgttattttgagggagaaacatgacaactaaattaaaacaagaatgatgtgaaagagagctcataagagtcacagaaggctaaactgcccaaaaaatgttcccgggcactgttgggcttgggagtaatgaaaagatttgcaaattctgatccagaacctttggcgtgcgggaggctcatagcttatcttccaggaagccctttactctatgaaccaatttcataatctctcttaacagttacctcatttccatagtggaaacctttcctgacttctttctttggctcaaaacttctaacctgtgaatgatgtacttccacagatgtgctagtctcttttgatatccaacaaaacatttattgaggaactcctgctggctactgttggcatatattatgttgattctggtcctgatttaactatgggttttgtcaatgccaattccttaaacatggatcttcgtcatttttaaatcagttttattccctttaggttgtttattggattttttaattcaactcacatttaatttcctttttcttttctatatatctcatgtggacttctttaagcatcagccacatcataaggataatggcatattgtttagaaacatattaagtaccttattggtacttaatggcatattaagtctaaacttaatggcatattaagtttagaaacatttggtacctcattgatggggttattcatttattcattccaattgcttgaaatatgtcatgaaagttctcattcctgccccttactcacagtgtatttggcaaaactttgaaggccattgtgttggaacaaacagaaagcgcaatattcgcattgtagttaagaacatcctgggtttaaatactaactttctcagttttaggtatttcacgttgcactgtttgcttagattctccattgtgaccaagagaatgtttatatcttacgactgtagtagggacatttaatttaataatttgtgcaatgcctttagtgcctactatgtgccagaaacgtaccaactactatgcctgctagttattatttatttaatgaagtgttgattcactgaactcaaattaaattatccttgctatccttgcctttctgttcttcatgccaggtactcagtgaggacagtctgcccatggcccacctcccaagggttgtcaattatgcaaatgagtcaccccatttagtaattagtaatgtttaaaaggaaagcccgggagattaatgcgatagcatacattacggttttggaattttaagcacagggcacctggttttggtaggcgtctttctttctttcctttctatttttcttcatttctcctctttttttttaattagccaaaccttcttcccattgcatttcatatcctctaatgtgaataactacttgatctactagtttgtttgtttgtttgtttgtttgtttgtacagccagcccttctggtgccattttagggaaagaacacagaagcactgcctaatgagtgaagtcatcacgatttcctatcacctttaattgtctgaagaaaatgattgagaagcagcaatcttcaaaaacaattgagggcaatcatgttgtcgaatttaaaatcatttctacttcagagaaattaaactttttttcttttctaacacaaaacagtaaatgaatcaaaaatccttttcttttttacccaatatattctaatgcttaatgtacttgcaatacaactttcattttctcaaaggcaggtcaagtgaacccaacaataaaattatatgttgtaaacctgtatggaccaactcacactttggagctcatgccacctgacagctttaaatcaaggtatgcaatttcaatttcacttttatggggaaatagatattttcactccaattatcattttgttgcaatttagagagagatgtgatcagctcaacaaatccacttgaaaataaagctgaagttgcctacattagtgaggaatgaagtcattctcggtctctggctgttcctaggaagcatttagctccaaggtgattatcagcaccatacaatgactgaagaggctgatactgagaattaggtcttttgctggagatgtgacagagatgggaacaaaagatcattttccactgaattttcttcaagaaaatagttgctccacattttttttgaaggtgttcattaaaagtgtataatctctctggaatttgtgagtttttccaactttctccccatagttttgccaaagattctctagctttcttctccagacatttaagaatttttttttcaaaatatcctatgtatgaaatacttatatttaagaaacttgatcagggagaaagtaaacacattttattgggtcagaagcataattgtaatattagcaaaatcttcagtagtgaacaactaattaaataatcatgtgtattttgaaatccatcatggtttcagacttcaaaagtgattctttcaaatactagagtcctttggaaatttatcacaaccctagagatgggataggcagctgatttagaaaaatgttttcacattatattgaatgatgtggggataagttcaaagtttattttgatgatatcgataatcagggtgattggttcccacagaaatttcattcaaatgttgtttcattgacattatttagaaaaaatttcatcccagttggtcattttcacagagagtgcagcctgatgtgtgtggaaattttacgtacttgaaaaggtaataaaggtttatggaatgcttactccagaagaccctcattaactacctaatataaacttctccttctactgatggaaaagataaatcccagtgagagtaaatgatttagattaggggctcaggactcattgataagaaaagtagaaaatgaagtaaggactctttcatcaggttacagagcatttcatccacgttggatggaagaccttaataataggcctgaattggcatataatgtaatacagttgaccaaatcaaatagtaacatttatttctgagcttgatctagcagccatgaatggttacgttacaaatgaaacaatgatggatactattgacattttatctggtccttaactcttatctttttctctggtttgtttaatgctatggaataacagaaaagggaaatagactaggagtgcttgagtcacatgtctaccaccatttcatttgtctcattggataaatcactttacctctctcagggctgaatccccttgtcttttttttttttttcttgagatggagtctcactctgtcacccaggctggagttcaatggcacaatctcggctcactacaagctccgcctcccaggttcacgccattctcttgcctcagcctactgaatagctgggagtacaggcacctgccaccacgcccagctaattttttgaatttttagtagagatggggtttcactgtgttagccaggatggtctcaatctcttgacctcgtgatccgcccgccttggcctcccaaaatgccgggattacaggcatgagccactgtggctggccccgcttgtcttgaaataaaatttctaatttttttcctttcaaaaaaagtttgcaatgggaatcaaatttacaatatccatgtttctttctaaaaggagctcttgattcctgaccttgattttttttacctatttgtataaatataaacatatataaattgaattattaataacatactttcttcatgtcctattaagttaatcaaatgtcctctcttctctttgatgtttgtgttgtgttcatagtatagctacctgtacagtttaaaatactgcctaaactctcaatagcagaatatttaaataattcattttataataatttacatgtttatgggttttttttttttagtatgttacttaagcatctggtatatttttataatctttaggttatctgtgaattgacagccaataagtgaatcatattatgtttctcagtacagttataaactatcatttttttcttttttagtacttttttccaccacacctaaaccacaaatatgatcatctcttagttttcttgtcttaataaaatcgccaaaatgactacaataataattgaatacatatatgattatgtctatataaggaggaataatagtaagataaatatagaaagatttttttcatgacttccactaccttataaaccagattctctgacctccacactggagaacaacatttttttgttgtttgaattgaagatcttaggtcctttttttggtctgtctgattgcttatttggatgattggtttccttatttataataactagtgtttatcactgtaatagaaaaagttccccaagctagtatcattatcccttcaacccaatacttatactcaccaaagactgtaaaatacattttaattaatttatatgatttagaaagaaattaaaaggataagataatctacagaaagacataatttcttctcctaattcttaccctcatagtctcttcaattgttttatttatttatgtctgattcagctgaagtcatttcatcaatttagacaatgagtgcaacttttcctcaataataattcagttcagactcatctcatcaccattcagtttatctttacctgaatcacagtctgtattgattctgaaaagaatgtagcatggtaggaactaagataatgcccctttttgaatatccccagaactagtgggagttggatgggttatctcatcttggaaggaagaaacattttgtcaaattgttgtactgtgcacttaaggtattgcaatcacacaatacctttattagaaaatttaagtgtgaattttaaaatatatatttactttccagggaaattttatcttatgataatgaatcatgaagattttccacagattggataagtcacattaatttggagaagtgatacgtggtcatttgtgtagacctctctagtctgaagagtaaaagtaatgatttgtccttggtttcttcttactctatgtccttagcattattttacttcttagaaatctttctgtagtcacttatcttttgtgacccattgttctcaacctgcatcactgatttaacatggtcattttgcccctgtgactctgggcttgacactgtcatgctttctctccctatttctttaagtatatctagcctacatctcttactcttccaaggagtatctgtgccttccaagaaaatctaattaataaattaacccatgttcatggaagtgtcctgaataacccttctgacaagtaatgcatagttattaacagaggtctttgtagaacgctagctataatttggtcatgaataccatcacaatatacttatgggaagacatcacagattatctagaagaaaatgagctcaaagtaactacaccgcacaaatattttggtgtaaacacagagcaatgattggacaggaaggccatgaaaacacggtgtaactgctaacatacctgtctgcaggtgatgctggggcctccattccacataaccttgtgtacaattagatcttctgtgccagaccacccagctgatagaaagtctgttgacttgagtgcaatccctctaactagcttgtctctgtctctgtggctcaagaggaccagatcctcgaggacttcctgggtaatccagagccatggagactaggaacaagcaggaaacccagttataagaaagggacacttctgctggccactggtcgtggaacaccagatctaatgtgttcatgagatggagttccaggaggacagctacatctgcagcaggcaggccaacgagtgtgacatttccaggtaagggtgcttccctactccctcattcagagacagcctgaatacttatgagtaagcaagatcagtcaatatgaatcacagggagatgtacacctaggctcctggggcaaggaaagaaaggatataggaagtgattgagttaatagatatatctttcctccctgcctatgtgtcaagctctacttgagcttccattttggctatctccaacaccttcatatagaaatttcagtggtttgaaatggtcgtttgttagactttaccaattaaaatttgtggagagctttcattcttcagattgtgtttaccatgtgcaaggtcattcttgggtataagcaaggtttgtaatgaggtatctcacatcagattatgctttgcttatgaccgtaagccacattatttaaaaacagacacaataatcacaatatttaatcaaagagaactataagtatattgctgtaaattaatgattttcaagttaacagtttacaactaagttagtgttcccttaaaaatcagttattcaccacatttgtactcgttggcttttcattcttttccaaagattaagttcttttttttaagtcaaaatttggcatcttagctaataaatatattctgtcatgcctgtgaggtgttgcaaagatgttcttgtagcatttcatttgagaccaactttgaaaaggaaagctctcaagatgaatgtttaaattctgttttgttgttggtggtatttatttttaaaattattcatgttagtttgttacctcatattgcacaaaatataatattatggcaggtaattgagacaaatttctgattatattagaaaagcaactatatatcagttcaatatagagtttaccaaaaaatatgaccttcttgattttgcagtctttggttagttgtttacaatattcaaattaattttttacttcaaatttcaacaacatttatatcaattattcagcatttcagcacttattttctgattatttatagtacttactatcatttttctataaactaaattctctagaaaaatctattaaaggttaatacttcattttctactttttaatattcacattgctaaatataatggtgtatgcaaaataatcggcttaaacgaaacacagtgaaagtgaacaggacactgttctttgcaggatcacaaggcctattgatatggacaaagattatacctaagccagctgcatatttgattcaatgttgccttattaactctacttcgggcactttatgttttgatttcactgagtttaaaggcagttttcaagcagagctcagctagttgtggcagctgccagatgtcttgaagaaattgttgaaaaaaatattacagccttccttgtatgtcaagttatgcttgcccttctactgacatcttcactttgataggctaacaggttttctagaggaaacagtagctactcggtaatgttagatatgtaacattcatgtagttgtatatctaacccagatacctctaaagacaggcaatttgtatcaagaggttatttttctgtagttgatatttttctaagtcatataaaactgggttaattaactgtgttttttttttgttgtttttttttttttgagacagagtcttgctctgtcgcccaggctgtagggcagtggcacgatctcggctcactgcaacctctgcctcccaggttcaagtgattctccagcttcagcctcccgagtagctgggattataggcatgtgccacaacacccggctaattttttgtatttttaatagagacagggttttaccatgttagccaggatggtctccatctgctgacgtcgtgatccacacgccttggcctcccaaagtgctgggattacaggcataagtcactgcacctggccaaaactagtttaattagttttaatacagtacattgatgacactttccgtgacacgtggatggctgtttcttctgagatcagatgagattgggcatgttcaggatggtatggctgtagactggatggctatttctaaagtaactgatctgttctgaaactgggcaagtttttagagaagtttttttaagtttttatcataaatggatgagtattgatgattgcattttgttgcgtgtgagttggaagctttgtgacatattgtatacctgtccaaatgtatgtgttacaaaggaagatatataaactttccaatcaccagttaccatgaggacataattggccccataaattatatctttattataccaagaatttaatagactcccatcttctttaatttgattcatttcttgtttaaaaatgtttcaaataaataagataattaacaatatggaaaaaattatgtattaaaaattgggactggtccttggtctacaactggcaaagaccaaaacaaaccattcataccttggtagccaaagtccccacgtatgaagtgaaataacacagaggttatgtataaaggatataattattaagccaggaataatctttgccttttaactggaagagattattcttgatgattcattgattgtgattttaaagaaaaaaataacatacctttataaatgtatacttgttttgcacttaaaggagtactaatcaatagaaaattttcataaatatctagcatgtcattgttttgatttttccaagaaatacttttctgggaaataattcactctcaaatttgttctcaaattatctgtatatttgtatacatatgtatacatccatgtgaatacatacatacacatatatttgtatttatatatgtaaatattgaaaagagcagatatctatttatctatctatctatacataaattaatatgtagcaacatccttatagtggttcagttattcttatatataaaatggcaaatgtatattgttggtactatatcaatgctctggctctaaacatacattttaattttgtttccaaactagagaatactatatcactatggttaaatgggtaagcaataccaagactgtggtaagatggttaaaccgagctcagaacatctccatcctcacagtctgtgagaccactacaggtgcttgtagtaaagtgagtataatttatttttcttttatgcctaaaatgaagtagcttatgcagctttacaaaggggaaacaggaaatgctttgtacaaaaaaaattcagtgtttaacttttaaaactaataggaaaagaattattctattaagaatatatactttaatttataaagcttccaaactttgaagtgaacaatattgatgataagcagaagagaacaaactgagcttttgaaaaccaaattaatttttatacagcatgaagtataatccaagccacgttagcttctttctcagatatggaatttttctccatattttgtctttgattatcttgagaatataagaagtttctttcctatcttctttaaacatattccttttaattttttctgtagttcagatagatctgataaaataacagtgtttctgtactgaaattaagtaaaacaagtaaaaaattggttcatgaactactctgttttgaaatcaggttatatttcaattcttaataccagtttttgtaaactctgtggtaaattcaatgtgtcatttttaagattcctggtagagaaaacactgcagtaagtttaaacggttatgtgtatggtatttgggtaaagcgtttttagattaacaactgaattttcaaacttctgttctggaaaagatggagtacgtgttacctgactagcttttctgttataaacaactgtaaaattgtacaaaatatacaaaacatctgttttcagatatgggacattaggaggatcatgaccataaatgctgaaatcaagtaaatgcacaaaatcaaccttgctatgactttctattcacaacacttttgagaccaaatggcaaggagatggagcccaagcaaagcaaaaagatttttgtgatctaagcagacagggagaaccagcgtttgaggctttttttggtgactagcatttataggacagggaccagagaagttggagctttatagaaaaggactccagcaatctatggagaggaccccttaagtattaggctcaatgcttagctgtgcatacctatatgtttccacactgtcttaaagaaaacaactactaaaaatttttgaagcaaatgaagaatctgcaagttgcaaagtacttagagacgttagagttctgaacaacaatagtgaagagatctccctgaaaaccctgggtattcaactgagaacccagaaagaaagcacattagaagtagggctagtctagacaccttctaatcacctttcaattacactgtaaggtatcaagttcatctgtctgtaaattaactgtctactaggacaaagtgtacatttttaaaggggaaattacaattgataaagactatcaacaatgtagcatttataatgtcaatcatatgatcaatactatatatgtagaaaagtggaaaatataacctactcaccttcctcaaaaatatccagtaaaagctgacctacaaaggatagtaatattggaattagcagacacatgttttacaagttattagaaatgataaatgttggaagtgatggatatcttaaatacactgatttgattattgcaccttgtatacaggtatcaaaatatcacatgtactccaaaatatgtatgattattatgtatcaataaaaaattaaaaatcaaggtaaaagttaagtacagtgaagtgaagaaatctcacatgtgcagttaaatgagttttggcaaatgcatatatcccgtaattcacacctcatcatgatataaaacatccctattatcccagaaagtttctttgtcctctttttcaatcagtctcagttcccagaggcaactactattctgaggtctattataaattagtttcgcatgtttttaaactgcatataaatgcatttatacaataacaaagttattagaaataaatctaacaacttagaatagctccaataaataaacaggtggaaattttagtggagaaataaactttaaaatgaaactaaaatttcaggaactgaaaaatacaatgtttgaaatgaaaacattgaatagacaattcagaaataaatacatgtgtttatagtgaactgattttcaacaaatgcatcagaacagatattagggaaaggacagcctctttagtaaatattgctggaaaactggatgtcaatgtgcagaaaaatgaaactagatgtgtatctctcaccatatacaaaattcaactcaaaatgaattaaaaactgaaccgtaatttccaaagctataaaactactagaagaaaacagagaaaatgcttaaggacattggtctaggcaaagattttatggctaagacttcaaaagcacagacaacaaaaagaaatgtaaattggtactgctattatggaaaacagtatggaggtttctcaaaaaactaaaactataattaacatatgttactagcaattctactactgggcatttatccgaaacaaaggaaattagtatatgaaatacacacctgcatctgatgtttactgcagctgtgctcataatagtagggatgtagaatcaacctaaatgttcatcaataaatgaatggatttttaaaaaagcatacatatatactttttaaaaagtatatatgtatgcttttttaaaaagtgtgtgtgtgtgtatatatatacataaaacattccattgtacatatacaatggaatactattcagccataaaaaagaatgaaattctgtcattcatggcaacatggataagtctggaggacgttatgttaactgagataagcgagtcaacacaaagataaatatcacatgctcttacgtctatctgggggataaaagaaattgcacttatagaagtagagagtagcattgtgcttataagagtctgaaaagcttgggaggaaaggatagagagaagttagttaacagatacattacagctagataagaggattaagttctagtgttctgaagcactgaaggttgaatgtggttaataatgatttagtgtttattttcaaatagctagaaaagagaatgttgaatgtttaaagcacataaaaaatgataaatgtttgaggtagtggatatattaattatcctgactttgtcattacacattttttacatgtatcaaaatagcactctgtatttataaatatatacagtaattacatgtcaactaaaaataaaaggaaaatacatcaccaaagtgaatgtatgaagaggaagaatatttgaataattttacatcaattaaagataaaaataaagaatgaattaaagataaatttatttagtaaattacataaatttaattcataattagaaaccttgccacaaggagaactctagaagcgggtggattgcatgatggattctatcaattattaaggaataaatcctgtaattccttgtcttggtttgttttgtgctgccataacaacctaccacaggctgggtagtttataatgaacagaaacttattgactcacagttttggaggctgggaaattcaagatcgagaggttggcatctggtgagggacttcttgctgcatcatcccatgacagaagggcaaagagagggtgagagagagagaaacaaaaggaggctgaactcgtccttttataaggagcccactcctgtgataacaaacctactcccataataaagacattaatccattaatgatggcagaaccctcatggcctaaatactccgtaagattttacctcttaatactgttgcaatcacacaatcacaattaaattttaacatgattccggagtggggagcaaatattcaaacactgtatcattctttctaaggagtatatgataacatccctgtactccttagaaagtgaagaagaaagagaacatttcaactaatattataagagtagaataatactgataccacaactagacaagaaaaatacaagagacaacattttagactgatctctctcattaacacgtgtaatagtctgttttcatgctgctgataaagacataccgagactgggcaatttccaaaaaaaaataataataataaggtttattagacttacagttctgcatgtctggggaggcctcacaatcatggcagaaggcagagaggaagaagtcacatcttatgtgggtggcaggaggcaaagagcttgtgcagggaaactcccactgtaaatccatcaaatctcatgagactcattcactatcatgagaacagcaaaggaaagattcgcccccgtaattcaatcaccttccaccgggcttctcccacagccatgggaattgtgagagttacaattcaagatgtgatttgggtgggacacagccaaatcatatcagcacaaatatgagaaagtccttaaacatatcaatactcaactccagcaatataaatagaggatagtgcattgagatcaaatgaggttaatcccaggaacttaagattggtttaatattgaaaaccaatcaatataatatattaagaaaaaaagaagaattaaatatcttggtagatgaagaaaaagcaattgacaatattcaaaaccaattcacgataactttcaatataaatgaataacaagaaacatccccaatctattaaaagatactcataaagtacccccttactgaatgtgcaaacactcaccttattcatgttaagattagcagtgagataagggtatccattctcagtactatcaagcaaactttaccagaggccccactcagagtaatttagcaaggaatcagtatagtgttaggaaaggaagaagtaaatctgtatttatagataacataactgtatacattaacaaaaaagcctacaaaaaaccctagaatacaaaatcacaatttgtaaggatgcaaatggggtaaaatataaacaagtggcaagtaagtccagagggcattcaggtttctcaaaccagtcttctaacttttgtctataagtttgtacttgtttcaaaataaagaatgaagaaacaacaaaacataatttctaaatgttagtgatattaagaaaaaaaatcagttaaaataccactaaaacccttaaaactttaaatacacaattataaacttaacaaatattgtgaaataccccaatactgaatactacaacattgctaaaaggcatttgaaagacctaaataaatggaagctattccatgtttttaaatagaaaaaattaatattgttaagatattaattctacccaaatttaaccataattttaatataataccaattaaagtcccttctgattttttttgtagaaacagacaagctgtttttaaaattaatatggaaacaaaaaatacctgaacaagtcaaagtaatcctgtaaaagaataaaattgaaggagttagccctacctgatttcaagaataaataaaaagctacaaaaacctggagatgctagtggaggcataaggaccacaaataggtcaactaaattgaatggtttgcagagaacagacccacatttatatgattgattgattttctacacaggtgctaaagcagttcaatggagaaaaatggtgctgaaaaaattggcatcccgattggataaaaaaaattgatgtttgacaactcatatcatattctaaaatcaatttgggataaatcatagccctaaatttaagagctaatactgtcagtgttctaggggaaaatatgaaataaaaccttactatactgaataagccaaaaaatcattaattatgaaacaataaattggacatcaataaaattagaaacttctcatcaaagacaccattagggaaaaggatatgcaaactacagtctggaagaaaatattttgccaaatgggtatcagacaaaaacacatataaagaaattctataactcaataataaaaacacaacctcataaaaacatcaaaacatgtgaacagttacttataaggaaaagaatgaacatatgaaaaagtactcaacatttggtcaggtatggtggctcatccttgtaattttagttatttgggaggctgacatgagaggatcttttgagccaagagttcaagaccagcctggacaacaaaatgagatcccatttctatataaaaaaaaaaaaataaaagcactcaacttcattagacattagcaaaatatagattaaaattataatggtatattatacataattagaatgactacactaaaataacaaaaaactgacaacattaactgttaaagaggacgtgaaaaacaaaaattctcgttctttgcaagtgggaatgtaaaatgatatgattacattaaaataatattttagttccaaatgaagttaaacatatgtaaacacaatttttttgtttatatataaataagaagacatatatacacacacacatatatatacacatatacattcatatataaaaacacattataggctgggcacggtggctcatgcctgtaatcccaacactttgggaggcggaggcgggcagatcacctgaggtcaggagttcgagaccagcctgactaacatggagaaaccccgtccctactaaaaatacaaaattaaccgggcatgttggcgcatgcctgtaatcccagctactccagaggctgaggcagagaattgcttgaacctgggaagtggaggttgctgtgagccaagatcattccatttcactccagtctgggcaacaagagtgaaactccgtcacaaaaaaaaaatacaaaaaacaaacaaaaaaaaacccatacattataattccattacaaagtatttgcacaagaaatgaaaacatgtgttcaccaaaggatttgtaagaaatagtctgtagagaagctttatttacaatagctaaaaagtagagactatttaattgtccactaacaggaaatagactttaaagtaagacttatctacacaatggaattctacttggccatagaaacaaaatactgatacgctcaacaatatgagcgaatctcaaaaacaagtggtgtggaagaaacctcacactacagagtacataataggtatgtaatgcatgatttcaattatctgattttctaacacaggcatatgctgtctatggggaaaaagatcagaagtgattgccttttgagaacctctggggaggagcatgagttaatgttttggggaaaaataaagatcctataacttgatgggataaacttgtcaaactcatcacattatacacttaaaatctgtgcatttcactatatgtgaaaaatttaaaacatattatttaaatggtctgtgaaggagagccctcaagaggcagacatttctctttgagtagaatgatgagcatagtcgtggaaatgagatagttaaatcaaccacttgatgctcttctcattaagcttgtattactagaaaattcatctctttcttttggctagattatagattgactagaatttctccacgtatttgttaaagtgttctggatggtttttattcggctgattagtaagtcatttaaaaattggcctacaggccggctgtggtggctcatgcttgtaatcccagcactttgggaggccagtgtgggcagatcacctgaggccaggagtttgagaccagcctggccaacatggtgaaaccctgtctctactaaaactacaaaaattagccgggcatggtggcacacgcctgtaataccagctactcaggatgctgaggcaggagaattgcttgaacttgggaggcagaggtttcagtgagccgagatcgggccactgcactccagcctgggcaacaaagcaagactttgtctcaaaaaaaaaaaaaaaaaaaaaggcacaggccaggcataggtagctcacacctgttattccaacactttgggaggccaagtggggagaatggcttgaggctgagttcaagacctacctgggcaacataatgagacaccatcttatttttacataaaaaattaaagtaaaaatttaaaaattagcctacatatattgtagttagagaaagcccttctagacaaagatactgtaaatatttcattgcatacagataactgcaaagataaattaaaatgctttaatagaaaatagatccagtaatcctatcatactattgatctgacaccttattgatattgtattttattctacgtatggagataaaaagactttgcattctgttaattgaaataatgagacaaacaataacaaatgaagttttgagctctcaggggttctaccaaaacttggtggtactaacaagcagtggcattggtatctattttatttctgtgctttacagatatcaagaatggttaatgctagggtgtaaatggagaataaagaaatgattcagttagattttttttgatatcttcacgtaatgaagatctattgaaaaaaaaagtgccctgaaaagagaaagtgaccaattataatgtaatcataatatggatttagaaaaagaaattagtatttaaaaacatataaataatttattattaacaatttgagatgggtacctctgcatataggaaagcccctaatatgttgttacttatctttcttaatttgaatacgtttattatagaatcatttctttcagaaaactgcaagatatttcatgtcattacatgtaaacggtattattaaagcttgttttttctacacatatttaacgaggttaaattagtctaattttgctttttgcaatatgattttggctctgatctactgcaagactgttttgaagggacacataattttgtcatttcaaatgtttgatattttttctcaaagactgagttactactgataagaaaaaaagaaggccatgattatgagtgaattgaatattgaaagaatgtccactttttagttttattcctggctgtttgcccagttgctttgaaggacttaataattttgtctcccaatgatgcctagaggtgaaaagagacagtgtctggtggttcaaaacagttgaatgaggtaatcaaacagagctggaaaatgatcttctctccctggtgaggtactgctgggaattctgaaagaattcaccaaagaaaagactttataattaaattatcgtttagtccctattctctacttactcattcagattaaatcaataatgacaatgaaatctctcatggtgtttcaccagttgaagagagggaaaaaaaactgataaccgtgttttaaaaaagttaaatttatatatgctcattttggtctttagatgcttcatggagttaattgttttgtttcagaaatatgagatgacatcagatacgtggctctctcagcaggtacagtataggtggtctgtcacatcttggccattgtgaccatcctgttcacccattttttatgtgataactttctgtaaaaagtatgagtttaaggctttgctaggtttgacagagtgatcctttttcattaaaaggatcacttatgacttgggctttctatggtatcatttgtgaaaaggttacttccatttttttaggagacataaattgcagagtagctgccaggatcactttttaaaatattctgtgtaagtacactcttgtgtagatgaaggagaaaaactcaggacctaaccaaactagaaatcattagcattgttcaaattgtctgaaaaattgacctgacctttacataaattgatcatggagatattcaaataaatacttctcttcttagttgtattctagctcacaattctagtttgtgacataaatgaggctggaatcaagatgaacatgacggactaaaaacctaatcactgttacatggtctcatcctggacaattcagaaggaaacaacacaaatagcttatttaaatatagctgaattcattttactcttaactacattagtgagttttgcaaagggaaataagatgtgtggtatggtttggtttggttttctttttgttctttaaagccctcttttattttatattacgtctatggcgttaatgaccacccatattttgagaccttcacatttatccagacacttcagtgagttctgaaatatccaaatttatgcttgccatctcctcctaaatctgtaaaagtagcttcatactccccaggtctaagctgaactcattccttttctagtcagtcttcttaatttttatcttaggactcaatgacataattatccattcagatgttaaaactatttacctaatagtcatccttgaatcttttctcatttttatctatctatatataattaatatgtacagattttactttcaaacatctctcaagtcaatttacttttctctaattcacaaacactgtccatgttcgaactacagatccagcaagtctcaacccctcaggcacctgccaatctgttcacactgcaggctaactgagtgacctttttaaaatatgcatttaattgttgctactaacattcccctcatacttgcacttccacaactcaaagaacttttctctcttctttctgtccttcagataaagaccaacatccttaaaaggtccacaagggattaattgaaagctttttcagctctgagtcatagaatcatttgatctgttttctccagtctagctacatggaccctcatatgcacagggacttcataagtgcccttccttctgaacaaaattccctcaaactttcttatatgaagcctatttatttttcaaaccttggcttaaatcacctatgtaagaagtcacttcctctaactagcctaaccaaatcacatctcccaataaaagttatattaaagtcaagtgtaatctttgtgtaacacacaattattgctatgatttttttttttgctaagatacaaggacatgaggatgttttttacttctaattgtaaaccaaacgcctagtatagaattcaatatgtaagaattcaatatgtaagaagagcttaatagatacttactgagtgattaagaagaaaagtaaaaaggattataaataattgtttgtctgaagggtaggtagatggatagacacagataaatgtttgtatatatattacgagtatatgtgtctttgcacatggttatctattaatataaatacttttatcttggtcaatgtacaaaataaaatagaaaaaaaaccctgattttacagctaataatagactcacaaatttcggttagatacagaaaataagaacaatggacaatatataacacataatacttatgcattctgaatttccctccattattaaacatcttttgctattactttgattgccagtgacattcataatagtttaacatatgtcaacataatgcatgttcttttgagattatgctatctaatttttaaatcccaaatttatgaatgtttaatagaaacttttttaaaaaacaaagcatccagttattaattattcagttagtaaatgccattggtcgtttatcacagttgatttttttcttcagatgctctaagggaattttatgaaatacttagagttatatgaaatttaatgtatgagcatggtagcagtaataagaagcagcaaatttctaagataattataaatttaatagaatcatcatatactgtctttttgcatagcagaaaaggcaaagagaagtaggcatgtttagcctagctttcaaaggacttgcaattgagatgaccagtgtgtaatatatttggtcaagggaatagagtccaatatccccagcttaccatcttgtgtgtcaaaaacactgacttgtataatgtcatgaaactgagcagtgagattggcaccatctgtgtggagctgaatgtttatcaccagacattgtcaagtgttgggggcagattttttagtccagcaaggcatatgagattgtagcccccatctattccttttctgaactacttctaaggtactagaactggggaggaggcaatgtaaatggaagaatgcttatatatctgtatatgagaaaaaagctattcatcttttgatagaagtacaaagggagaacggtaagggaggagttgctatgtgggggtaaatctggtggatagagtgatatataaaactaatatttttgttcatggtatccatatattcatctattcaccaattatgagttgggacctactgtgtcttaggcaatagagctaaacagataacatttaaaatttagttcaattattaattgcctagtgaaggaagccaacaagttaatagatcaatataatagagtgcattggaagccatgataaagatgaaaacaagatagtttttagaatatctgaggagagatttcctaactagggaaatcttggaaattcttttgtttcatgagaataagtaaaaaatgagtaagatttagcagaaaaaggaagacgaaaaagttgttccagacaaaagaaactccaagagagaaatatcccacaggagcaggtgatggaacaaatagaattattgactttattatagttgaaagaagtgattcactcagtcaagtattttgtcagtatccattatatgctcagttatacaatttttccaaccttgaatggtatattatctcagagttttaaatttattacatatgttacttatattttcatgaatgttcataaggcagttaaggaaaatatccttattttactgtcaagagatgtattgtgaatgaagctaaaatcaaactgttcagtatattaaaatagttattaattgactgattcattcagtaaataattattgagctcaatttacatgatagtcactgtttcaggtgctgcagatgcagtagtgaaaaatacaagtttcctgccctatggggcttacattacagagaactacatacatacatacatacataagtatgtaaatatgagattagtgcaaaagtaattgaggtttttgccattacacggtaggtcgcaactcataattgatgaatagatgaatgtatggatacaatgaacaaaaatactcattatatatatgtgtgtgtgtgtgtgtgtgtgtgtatatatatatatatgtatatatatatgtatatatatatatatatcactctatccaccagatttacccccaccattaaaagtaatggaaaaaacctcaattaattttgcaccaatctcatacatacatttatatacagtatgtacatatgtacatacattcatatacatattttgccattaagagtaatggtaaaaaccacaattacttttgcaccagtctcatacatacatacattcatatacaaacaaacgcatacatacacaaattatacgttgaatggtgttagttgctgtattagtccattcttgtactgctataagagaccaggtaatgtatgaagaaaagaagtctaattggctcacagtactgcaggctgtacagaagcatagtagttattgcttctagggaggcctcagaaagcttccagtcatggcggaaggcaaatggggagcaacacttcacgtggcctgagaagaagcaagaaagggatgggggaggtgttatacacttttaaacaaccaggtcttgtaataactcattcactcactgtcatgagacagcacccagcggttactgctaaaccattcgtgaaggactcacccccgtgatccagtcacctcccaccaggccccagctccaacactggggatttcaatacgacatgagatttgggtggtacacagatccaaactatatcaggtgctatggaaaactagaaagaaaataaaaggagatgaaggatgtcagatagagttggatggtctgactttcctgatctcgctttatatagggtaataaggaaacaccttattgataaggagatttcggattagagacctgaaagagataagaggaagatccagaccaagggaatacaaagtacaagagccctggagcaggatcatgcaggaacccagtgaagaaagcaagagaatgacaaagatgagatcagaaagacagtagagggccaagtcatctaaaagggcttgaaggccattgtgcagagctactcaggacccatatcaaagcctttctttataccatatataaccacctctcgttagtccagcaggaaaaactcaatgtttcatcagataaatgtgttttcttaatgtttttcctgaagaaagagcagtatctctctctctctacatacatatatgtgtgtgtgtgtgtgtatatatatatacacatagtgtgtgtgtatatatatacataaatatatatagtgtgtgtatatatacacacacataaatatatagtgtgtgtgtgtatatatatatgtggctttcatcatttaattttcaaaaataattctattgatttaatgtgccaccagagtgtaattaaaaattatcaaatggggtcacagttgtaggtgggcatttgtgtttgtgtgtttgtggagagatgagcaataaggatggtaaatttgaattaaataactttctatagaatcctttcaatttcgtggcctgtcgtcttttgtattttcagttaatttatgaatacattatcagaaaagaatcttcaagtaagtacagttgctgaagaaaggatttcaaaaaatatgttacagaattttgtaattaaaagatttattttgataaactgatgcagatgtttgcatgttctttatctttgaaggatatttcactaaacacaatcttatgtgaagatatgacagttcttgtttgaaccaatttaaaaagtgtctttagtctgataataaatcattcatatccaccatgcacaaatttctcctatccttcccacaactcaaccacatacatatgtaatgtatcagatttactttaaaaaagtttaaaaaatagcatacattcatttttttaaaataatgtgcccattttcctaactaattataaatcaatatttggtataacccatgcaggaattaacagtagtaggcagcacagattgcatgtgcctttctgagattgttctgtgctcttctgtattttagaatgaggagcccgtgttttctagagacggcagcaaattctttatgacagtgcctgttaagcaagggggacgtggagaatttcaccacgtagctatgttcctcatccaggtaagtgctggcttttttccatgttttgatttcattgtcctcatgtccccgaaggcccagttcttgtggcattctaaacctctagttcatggtggtgaaacccagccatatatacaactcacagacatcttaggaagaggacctccatccatagccatacattcaagccttaccttcccacaaaacagtctcaacactcagtacaatttaatgagttacatgtgtgtcctatgaactgagggctttgggatagagaatttaataaattaaaagcacccaacttttgaggacctgagataatctagagaagattttttattcaatgaacatatatataacctattttgtacaagtaatattctccaggtgttataaaagttttaaatactcaaaggaacctaaatgtccatcaaaaattgatggttgaataaattatggcacatccccacaagcaaatacagtgcagatttttaaaaaacaggataaaatagatgttttatgttaaataacatagatttcatgttgtaaaatataatctatgttttttttttagactttccgataaaaagaggggaaaggttactttttatctaatcaaaagaatatgaagggtttatacagttttattataaaaaaattagtaaattcaggtagttagtttaaatttgacaaggttattgagtcaatctgaatttaatttccaagagcaagcatacatgagaaaataaagcatccttcaaaatcatataataaataatctagtctcacacacaggttaaaggctttctaatgaaaagtcactgtggctaaactgggatcttcatgagtgttttacaaactagctaagagtaatttcatacttacaaaatatagaataaatataaatatggcaaagatacctaactgaccttactaattttatgtttttagaacctttaagacctgtgcacattctcaaatgattaccattatccatatacatttgtattggacagcttaatgctttagagtctcaaaatcttatgtcactaatttaaaatttaaaacttgttcagggtctgtgtaattaaaatagttgtcattgttttaactttaattttaattacgactgaaagaaataatttggaatacatacaatttccacagtacagatgtagattgattttcatagtatattattaaggtggaaaaacaggttataaactaatgtataatgtgatcctatttatgctctaaataaatgcatttatagatgcatttatatatgcatttatagatgaataaaattttggatgtttttatatctagctattaaaatgattatataagtcaggtataattaagggaactttttttatgaaactgaaaggaaatagactagcaaattactttactttataaacttttgctaattaagagtcaacttggttatcacaaatattagagaactattttggcccctaaaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtgtttactttgttcctcttctatatagggactataacacagccttcattgaagtagaaaacattttttttctattctggttgctgtttaggtaatttgtggtttgcctcattgagaaatgaacatgactgcatgattatttatgaatattttggcaattgattaaaattagtctactttgctaatgagtcagaagtcagtgctaggtaaatacaatttatacataactttgaacacacacaaacacaatcacatatgttattttaggaaatggtttgaatcaccttgcctcaatttaaaaatagctaacaaaaaagctatttatgaattgtgtatgactgcttaattgacatatatgcactataaaattctgaaaaattcaaacttaataaactgataaaggagtatataaaaatcacccacaatatcatcacctcatattctcacacttttaatccattattgtgtatattttacattcttttttcatgagaaatatatgattttcccctaaagattgcaattaaagcataatatagatttgtaacattaaaagaataactaatgagtgttttcttacaacatttaattgtattcctaatatttaacattttatatttttcttaaatgtgattttaatagctgctcagcattacagcaagcagatatactgtactgtatttatttatttatttatttatttatttattttttgagacagagtctcagtttgttgcccaggctagaatgcagtgacacgatctcggctcactgcaaccccctcctcccaggttcaagccattctcctgcctcagcctcccgagtagctgggattacaggcacccgccatcatgcctggctaatttttgtatttttagtagaggcgggtttcaccgtgttgcccaggctggtctcgaacttctgacatcaggtgatccacctgcttcagcctcccaaactgctgggattacaggcataagccaccacgcccggcctgtactgtatttaaatgatccaagtttattcatcattaaagttatttctatattttgatgttagaaatgattcagagttaaaagcccttataaacactttacttataattcttcccgcaaaattatatttctagatgttaaaagatacccaggcagggtatatccatacgaatgtatttgtttaggttttgatgtgtaatgccaaattggctctccaaaaaatagtacaaaaatttactgcctaaacagtaatgcatgccagcattgatgactttttaccccctttccttcccttgctgtgctacatgattctacttaaagttgtcgtgcctgaaaagtgagaaatgacaggactggggccttggcagccaacagtcagccaggtcacctttgcagtacttggcgcttacctatgtttgagagcttactagttcactcagaatatatttatttgcttgaagtaccttactaaatgaaattactaaatttttgcaaacattttgctctctcatattatcagtaagtagataaaaatcattaattagagaccaagctagacaattattgatttcaagctattttcattatggagagtgatggcggtcactacatatattttagtgggtttttttttttcctcatttacaagagctgtccttgttaaagtgattccaaaggatacaaataaaaagagaaaagaatgcatgtgttttcctccagtcttcatttaaacattattgtaattttatgtaaactacagtattgcatcctgatatgtcaaatttaaattttaaatgcacacttttcccacaatgctaaataattttgaaaaataattctttagaagattaatattgagttgactggatgtgcatcaataaccattatttgttgttctgtgtttaatttagtggcaatttgttgtaatgatagatgtcactgtatataaagcttatttatattgtggattatttctttagtattgattaacaaaactggaatagctggaccaaaagtaaaagatttctaagccctaatatatgtatttccagatcactttcagtatgaatatatgaaagcaaaatttgtgagtgttttctccactttcatatattccattaaagaaaatattaaataaaactatggcttttctggaaatctatatagctaaagaaactgttcttctggatagagtgttttgtacacgtattactatcagtttatgtacttcctgagtcatacactgatacaaaaccttttaccccagaccattaaacttttgatcacttcagatattcgcccctttgccccttgaaaaatatttgttatgttgacttcaaacttctgaattctcatctcaggaactgtaacattctacatcctgcaattcaggctgcagtgaagagataggtttttatcaaaggtatagcacctttttctctcaaagatggagtaagcagaattttcattgtgttcagtcgttcagattcataggcgtaaggaatggccctgtcaccttctaaaattgtgttaaatgaaaaattatatgtgggtgaatccattcactttctctattcagcaacacgaagttttgcccatgagagctgatgatttcacttggaacgattttaagtggcattattcactacaaatactgtggaaaacagcatgcccccaatccacaattttatcacctaatcaacccagtaaaatttttgcattaagtttcactgctgcatctgattaggacattgtctgaaaacaatgagctcatctcatgtggtgaatagatggcaaattaaagcatgctatttttaagcactacaatatttcccttatttagaaactataaaagtgaacatttaatataagaaatgtgaatgaataatgtgtaattaggtaaaaagaacatgcagggttaaacttgtattgatacccaatgtgtttccaatttgtaaatcgcattataaaaccaatatttaacttccttgagcaagataaaatctctatgaattgaaggtcacttgtctggtgtctaatgctccaaataaacactctattccaaatttccagccctcttttaagaatgaatgagctcacgacttttgttgctttttagtctgaaattaaagttgaaatattagttcaatttaaaatacattgtcatactgcctttatcaaaagtctactacagttttatatttatattcagtatttctattctaccaagttaatattgcagagattatggattcacagaaacaaagaaatgttattgtagagaaaaaatgctgttctttcctgctttgttaagtgatctttcctgtgattgcatttctgctgaaggtgcttaaaaacctaactgaagtacaaacatccccttgtgaaatctgctcaaatactgtgatatttattaagtgttgttcagtcatctaccatattctgattggtattaagattattagccaggtcaaaattaatgtgctcactgctgtgacagtcttatgtagattattagaaagtaaatctttgctattatatgcaaaatgagggttcaacttgttccccataccatatttgccctggtagattaaaagcaagcaaggcaattacagctgtttcaaataaaatcaaaaggttatatggttgttattaaggcttccaacaagagatcttttggtcctacacttgaaagtgtaatattttgaactaaaaggatcattgaagtaaatcatatataatattttttatactgtgttcaaacatttttcaaagcattgggtttttactcatggcaattttaatgttgtatctcatttgtctttaaaacacacatacacacacacacacacacacacacacacacaccaaaatactctgaaaaacagagaaaataattaacctagaaatctgtgggccaaaagtgtctccagatgttttcaaatattgagcaaagtttcttcacttttttaatgttttgagattattttatcttgaaattggcatcaaagatgcactaaaaccttgaaattttagtatcctgtccttggctcattcaaagcagggcctggaaacaagaaagaggagctatccactgagttatttgcctgtgtgaacttggcaataaaatgtatgactttagaactctgtgccagcctttgggttatgcagttctcatatctcacaaattgggtgtctttgcacttatacctctagtcaacaaatacttgtaaatcagtagtacgtcagatagtatacaaagaagttgatataaagaagtcacaggcttgctgttgaccttaagcagctagacgtctagagaacttccactaagaacataaaatagactacttagggagatattgaaatgcaaatacataccaataagacagaaaatttttcaaaggaagattctgttagtacacatgtgcagtaaagtatggaatgcccttttagtttacactttcagttgtgtgggaaaatagatgttataataaaactatcctatatgaacctaattctgaatttatttttaccaaaaatgcattgaaagcattactcagctgacagattacactctctgaagacaatgaaattgaattgcacaaataacaacatttaaaaggttatacatttggaaacaaaatataatttctattcatagtttcaagaagaaatcagcaaacacttagaactaaatgagaatactacatatacgaaaatatgcaatacatataaacaacagtttttaatatatgcaataattttatatgcatatatgaaattatgtatatatccaatgtcagaatttagaaaaggaagagaataaattcaaatgtaaaagaaaggtaattagaaatgaaagaatagcacttattaatctagtaagcaaacatgaaataaagcagtatgataaaacaaatagtaagttatttggaaaaagtagttgaatctataagagctgtcaagggtaataataacttggacagttccaaagtataaataatggaaagggacaaaactacagattttaaaaatattaaaagaatactatgaataactttacattgataaacttgaagtttaggagaaatggatgcaatctagaaaaaaaaatcaaatcagatttaagaaacaatcaaaatcctccatagtgttaagaaaatggaatcagtgatgtaggattttccacatcagggaaaggttgtttttaaaagtgaatctcaccaaatattctaggagtacgcacttccaattttatattattttgaaaatgaaaaaatatggcatgtctttagtacaatttatgacatgggtatcatcttgtaaccaacacgaaattaaaacagtatcagaaaagacagtataagaaagcttaaaaatactaaaccaattattgacaagttgacttatttaatgcatttaaaaaattaactcttattttttgaacagaaatgcaaaatttacttaaaatttcaaaaatatgtaagataattaactgcatttaaattttcctgagaaaattataatcaccttaatagatgcagacataggatccaagtaaattcaacaaaatcagtattcaaaaaccttagaaatttaggaataaagggaacttctttaaggtgatgaaggcacttgccaaaagctttattcatatagcataattgataatggagcagtagtaatattccctttaaaatcagcactgagataaggaatcagagtgaagtagcttgagtatacacaacactagagataacagttgtttttgtttttagctgttgttgttttatacttgaagctctggggtacatgtgcagaaggtgcaggtgtgttacataggtatacacgtgccatggtggtttgctgcacccatcaacccgtcatctacattaggtatttctcctaatgctatccctcccctagcccccaacctcctgacaggcgccattgttcagctcccacttatgagtgagaacatgcagtgtttggttttctgttcttgtgttactttgctaagaatgatggtttccagcttcatccatgtccctgcaaaggacatgaactcatcctttttttacggctgcatagtagtccatggtgtatatgtgccacattttctttatccagtctatcattgatgggtatttgggttggttccaaatctttctaatccattctaatcagtgttctctaactacataaagtggttaaggaatagaatgatagtatttctaagaatactttttgggtcaaacaatatatattttttagacaatactactacctgttttttacatattaaaatgttggtcctataaacaccttggaagcattgattaagctaattaccttcatcaacatgaattcatctctgaaaaaaaattattgcattaaatggcaaatcttataacaatgcccatactgcaaaggttaaaatgaatacaaacctgagtatttattggagtaaagtttgttctaaaatgttttttttttttaaagctaactgtacagctgccagtcatttacatgagagtgattaaagtcctaccttggaagcaaatgctgccatcaacatggtatacttgattcaccctcacctggaggagttttctgaatgacttttctatagttgaaatgaaggcactaacctacctgccttgatctgtgtttataggaatgcatgttcattcttgagctgtggaacagaaaactgagtgttaactgagaattagagaattcgaagtgtcacaagcagttggtacattcgtgtttaccagagagatgctgtttaaatgaaaggaaaatcaatattttctatttctttgcagagtaaaagtgagcaaattaccgtgcggcatctgacatcaggaaactgggaagtgataaagatcttggcatacgatgaaactactcaaaaaatgtgagtgttttcagttctctagtcaggctgcaagttagcgttgtcaaatgccatcttttctaatagaattatgttttgcttaccatagtcctagtcaaaacaagccagccatggaaagaataacctttctttaaagacctcttccacacttcacacagagacatcttacacagagggatgtgtgtgtgcacacgcacacacacacacatatactcacacacagtgattgagagaggttatgaaaaaggatgattttatcaggggaaaaaaatatgtttcctagtttgatcatagccctgtgtttgtatagcaaaacaactcctgtctgtattttgacagttttaaaaattcaagtgaagatttaatgtgaaaattcaggtgaagattcaatgtgaattcaggattcaatgtgacaatgtgacaaaattcacagatcacaaaaaatagatctgtgtctaatgcttgtgttgttttctttcctggacagttactttctgagcactgaatcttctcccagaggaaggcagctgtacaggtaagcagtgtgcaaggatctccttacacagattggcttctcaatggctatctatgtagcataaggaaggaaaggaaaaatttgaaatgtctttttcaacatggctaggaagagccaactttgctgacaaagcttcacactcttgcaccagtctctcccttgacaggactggagaaaatggagccctgcttgctccttcctgctctgcagcctccttattcttttcttcacctgcttttgcagtttcttaatatcttttttgtggcttatttctctcaactctccacatcagagagatttacgtattttccctcgtgccttcatcttctgctaagtctcattttgaattttcagtgcattaatgtggcacaggtgaaatttattcttgtacaatataatgttgttgtgaacagttagtctagtgtatcaagcaggaagctttccctctttgtcttgttgttcataaaacccagtgagattgttgcaggaggaggcatccttatttaaataaggaacgctcattgcttgctaaaataaagcaatataggggaaaataattacatttgttcaatttcccaaatgcaaaactatactcaaaaaaaggcttaagctcacacctatttagtattaaaatgtctcctcactcagagagctttcaccaggatctcacaaaaatgacttttatttttggctggcaagcaacctattaattctagactttatatacatgttctaatttccatttcacagatccatttttaaagtgtcaaaactgccatgacatattctcaggggaaattcatcatgttttaagaagtgtcaccactaattcttaccgagtagtactgactttcctttgagagtaaaaatgcatgcttaaagtaccccgacttcctctgcatcacccccacactcttatttatacacaatttgctttcatcagaagcaaccttgtccttttaatcgcctttcttaatacatcattattataagtttattctcgtggacctcctggaacgcatgttcttaattctgacttccaggaagcaaagctattcatatagagatagtgatttgaattttggattcgggatcttgatcaaagtactggtcactttttcttttggtgacctaaagcttatctttcttgaaacatacattatgattgatatcggtagccataaactgtagcttagagagatagaaacactttatatcttataaaactctcattttataaaactcaaagaaaaatgacagcatcagaagattagacttggtcaagttcagcaaatggaactgcctcaatctttcttcccattattagtgtaaaatgtgatttgaatcataatgacttcttagatttgtgtgcttgtcttatctctctagtgactgaggcagaacagtcaatgtatctctgacatgtactagtgtagtcgacagtgttacaaagaaaatgtagtagcaataaattttcccttaaatagctcatcaaatgccagttggcttgactgtaagataatgttagtgtttgacccagaaaatgcaatcaatgtcttgcccaggctataaaaatgatcactggttgacttaatatatggcactaggcacccctgcaggagtaggactgctaccgtagtcattgttactttctttgtctcaaaatttgtgtctctttatttcagcaatctcataatctaaataatgagaaaataccacataaatctccagggagcttggatctaaaagctttatggaagagtagagagaaaaaggttttaaatcttagtatgtcactgaatagctgtatgcaactgggatactttctaagcttttctgtggtgaaaattgtacaatgttgtgaatgtaattaatgaaactgaattgtacacttagaaatgcttaaaatgacaaatgttatgttatacaggtttaacccaaattttataaaatgaaaaaaaatggctatggatattttataagttatcatgagtgaaactaatatgatttgtgcttggtatatattgttttgagtattataaggaaatttttggattgtaatcatctcacagtgtttcaaatatggaattgtgattttgtgaactgtttcttgtagctgccttaacacccctgttccaatccccatacctacagcgtattgcacatcaaaatcaacgtgaatattgttcatttgtaaatatacgaccaaaaatcatgtttcattccaaaatgaaattgagaccttttgtctgatcaagtttttctaaaggtattctcaacagtgttttcatccattgacctaccaaattttgcattcagacttatttattaaataaacaatttgataaatgaaatttaatcttatattaatttttcaactcctgtaaccttaagcaccactattgtaaaataaagatggtgatgactcttctttttaccacctcattatgtcaaagtgtgtattgttgttagtgttatatgtgttataatacaaatgtaacttttttaaaatcagtaatttttctgcaagtaaatgatggggaaaatttggcactgataccaaattctaatgtttagaatgtttaatttagaaaatcatgagctggatttttttgtttgacttgtggaaatgcatattccttctttcaattagtatgtattaaacattgaataatctctgtgggaaattccctttaagactttacacagaaatatctattaaaaatgcaaaaaacagtaagttaatttgagttccattgaaatcagttctttgtttatagccatacatacaagtgtacatattacatacataaaataatacataattttaattttaatagattaagaaaaatgtgtatgttttaacattactaatagaaggtgactttttatgtatatggtgattcatagtttacagtgaacctctatgcaagcaccgatgtaactcccttgtttatattatatttaaatatgaacaccacacattcaagtgcctagaatagtagcatttctataataacttcctttttctttctccagtgcttctactgaaggattattgaatcgccaatgcatttcatgtaatttcatgaaagaacaatgtacatattttgatgccagttttagtcccatgaatcaacatttcttattattctgtgaaggtaagataatacatgaattctgatataatatattttattcattgtatttggtcaatatctgttggtatcagcaactattactctagatgatttcataatcttaatttataaatttttgttaataggatatacattatatatagacttactgagatacaattttttacatattttgtatagaaataaaaaatgagaataagtcaataaacatgcacacataattaataagtgctatttgaacatgagcaactttaaaaggtgaataaatatatttacatcagcgaggccatgccacaatcataaactaatttacctagtcttcagaaaaagtaatagtctagtcttctttttaaaacaatgctttggttgttaagagatttaggatctatggaaatttaggacctgtggaaattgaattcccctgcttcagagttcttcagttctgatcaattacattcaccattattacttcttctatcttgtaacaatatgcgtagtcttacatgtttatacagtatctctacaatatattcatagaaatcattttccttttaatatggtactgtattttccagagattaaatagaactcatgtgtcctcttataatatgaagagttgagtgctactactgcagctgatatattaagctgtccttttttaagagacaatgagagatataccaagacttactttttgacattgtttttctcttgatatatgaaatgaagtaatcaaaaaagaagtccttgtttaatgacaccaggaaaaaaaaattagttttagatgggattccttagagaagtgaagtttcaagataactttttacagtaacaaattagctagtgtattttaaatatttgaagattatggttaacgtatttttaaattaatatatagttaccacccaattttaaacttttcttatggatgaactatttccaatatgcgtgctttctttttttggctgagtggcaaatagaatttgatcttggatcagtggatgaggggtgaaagggttgtgaatcagctttgtgaacatcagtggctagtctataaaagactagagataaagagaaagcatgtagaattggctaaaaacatagaaatatagaacatttgggggaagagagaatcttaacaataatctctgcaaatagtttccttctcatatattcttacccttctgaataaaacgcttataaataggaatgaaagctagttatctggtttctgttttgttatgttttaaccacgaagtgcttccatttggggggaaaaaactattatgtaaactttctaatgattattacttagacatctttaaaaatatttatacacatatttttaaattccaggtccaagggtcccagtggtcagcctacatagtacggacaacccagcaagtgagtacacaagaagacaattaagaatagttatggttggcattagtcttagacatcgtgttatctattctgagtcatatcctctataaattcttcttcaaaaaatccccaccatgaggaaagctgcgtgtataccatcaacttgaccttatgtatgtaagagaaacagtaaagcaagagatatgagccatgttacaggtgggaggtgaatcttatatgcccgaaataggatatctactacctaagtcaaatagagttattgatgaaacaggtacattttagcttactggcctcttaatgttctggttcattcttgcctgggcctcacataagttattcctccagaataaccttttgaagacatttcagaaaattatgaaaaatgtgttattttatatattttctatcctgtttgttccagatatccaggttcttctagttttgtatatgcactttttcatttatgaatttattcatttgtatatttgttaggtttgttaagagatcacctacttttgtcaaacaatgtgacagagtcggagggtacactgaaagagtgttttgttcaagaacttacagtaaagtagataaataaatgcatggttgagcttatcttaaaaatgaataaccagatttcatcctgccttcctttctctttcctttcttccatgtttgtatccttctttcattttttaagttttatttaatcaatgcttctattctgtgatgatttcacataagctactataatctaataatggctcatatttattgactcacttgaactttggaatacctctgagatagttaatttgattatccctttttacaggtgagaaaaattagtctcaaagaggttaagtggtaataacttggccagagtcatactaataaatggcagaaccagggatcaaatgagacagtctgactcgagaataggtttataattcactacaatataataactactttttctattgtgcttttgcctcatgcattgcatactcttatttaagtaggagtcagttaggtggcttgacttagaagatatataggtaaaaaagtgtaaggttgaatgacaaatatcattttgagaaaacagaccaagaccatttatattgttcaaataatgtcatatagacacttagtgcatgcccgaggcaacaagaaatttctaaatttgtgttgggtttttgtgtggctgaaagatggtttagcacacattttagtttctatttatttcattatttccgtcttcagtgtaaaccttaaaaagattatgttaagcaaatcaaatatattcaatattaactctaacggcaacaataatgaccatagacagtacggttgataaaatggaaagaaggttgaatctcatagatagaactatcagtgtataaaataagtctatcacatgctttttgtgggatccaagacagtgcgttaacatctcaaaacatcagtgtcctccgagacaaataaacaaatgtgtttgcagtgaagatgagtaacattcatgacatataggacacacttaatcaataactatttgtgttacactgtatatcttgcctttaacaaaggatgattaaaaattttccaatctgattttaatttaattttatcctgttgttacaaggcaatgtcttttctaataacttctgctgcaaattacaaaacatttctgtctaagggaaatcatgttattttcctgttcaaaagccaatcatgtttgtctcaaggtcaacaaaaacaaaaaaaggctgtgaatagtggtcaagtgcttaattttcttttcaaaagataattacttagggagataaaatttatagtcaatggcaagtaaatctttgggtcaatgaaagcaaatataccaatgagtaagtcataactcatttttgggccacatgaagtagaatagtgcatggagagaaaattttaaaaaagaaaaaggaaaatatttaacaagcatggaaaacctttaaacccactagttatcaaagaaacgcagaagaaactactgccatgtaatttttcctaacaaattaataacattaaaaatttacattactaataaagatagaatgtggtagaaatgttaattataacatattaaaaataatagtcaaaacttatttcttttgtttttttgagacagaatttcactcttgttgcccaggctggaatgcaatggtgtgatctcagctcaccgcaacctccacctcccaggttcaagcaattctcctgcctcagccccccgagtagctgggattacaggcatgcatcaccacgcccagctaattttgtatttttagtagagacggggtttctccagttggtcaggctggtctcgaactcacaacctcaggtgatctgccagccacagcctcccaaagtgctgagattacagccatgagccaccatgcctagcagaaacttaattcttttatatcattttttcatttttgtagtttacactgagaaaataattctaaatggagaatattatgacaaagctattgaaaatagaaaaagacattataaataacaaataatgggagtttgtaagtacattttaatggaatattactcagtgccctgggcatcttccatctgtttttccagaaccacttttaactctcaattcttctcttcgatgttctctggcctagaagtactttctatagatgacttaggttctgttgccccatggcttccaactggattcaaccaaaggaaatcttgtaggcaactggaaagagggagaaaactgctctgggttgtttattccaccagccgtgttcctatggagtcaccacaggttggctgtgacctttggctgaagggaatcttcacccttgaccttcaggcccagccactgttttcttgaagttttctcttttcactgtgtttctgccaggttttggtatcagaatcatgctgacctcatagaatgagttgggtaggaatcccttccccttgattttttggattagcttcagtaggattagtagcagctcttctttatacatttcatagaatttgaatatggatccatctggttccagcctttttctagttggtaggctttttattactcatttaatttcataaatcattatcggtctgttcagggtttcaatttctccctggtccactcttgaaagggtgtgtatgtccaggaatttatcaacttcttgtacgttttttagtttgtgggcatagcggcactcataatagtctctgaaggctttttgtatttccatggggtcagtggtaatgtcccctttgtcatttctgattgtgtttatttgacttttctctcttttttcttaggctatgtagcagtctattaattgtatttatactttcgaagaaccaacttttggtttttatgctttttcacgtattcatttcattcagttcagctctgatgtgggttttttttttttcttcctcctgtagctttgggattgatttgctcttgtttttctagtttctctgagtgaatattcaccattttttaagcatttaaaattaaatgcttaggatagcttctttggaaatacactaatgtttaaataatcagagtttctttccattttaaacatgtaaaaaacctcttagaacatctagtcttccagatatatataataggggaagatatttacttacaaaagaggtagtttgatgtgcctgaggttacacatagacagcgtagtccaatgggagaaacataaaattacatgcttataacagtctatgattatttctctagtaaaagtgcacacagttcaggacaagaggaagtcaatgagaagacattttcagaaaaacgaatgtgtgtatacaaacataagaacgcataaaagtgttcacatttgcaagataaacattgttcatcatagctggaacaaaacatttactaaaagagcaaaactatatgaggccagaggggcagactggaattggattataactcttatgttttctaagtagtttggattcaatcatatttgttcaatgataaacctttgacattttattttattttttttctggccatggagtaactggaaatagacctgattcccttgtttcctttaataataataaaaaaaaagagtaaagaaaactggacaaaatatacaaatcaactgtttccagacattcaacaatagccagcatgggtctctgatccctgaaagaaggaaacaagtacaattagtgttgtaagttctctggctttcttgttaatagaaatttctgaactccaatgcaataaggaataagctaatcataatacaatgatatctctgagttgaggagacagaaaatgatattcagaaagattgaggcttatggaatgttgaggaatggtatggaattttatggaattgaggcttatggaaagatgaaactggaaatgaagaagccacatggagaaagacatctgcatagggctggaagagggatcaccctgaatcagctgctgaaaatacctagctgagtatgcataggaagatgcttcatgagtgtgggcaatgccggagctcacagagtggtgggatttgctcaagttataatcagcacagtagtggaacatttagaagagatcccagaagtgtcctgccttttgtagtgctaaactagccatagagcaaaggtcattcaaatacacactaaaaagatttcttgaaaagtcttgaaatggtcaacctgcctgcaacatatgccagaacaaagtccaacaattgttagaagatcacaacaaaacccaggctttcaaaatgtaaatgtcacaatggttggtatctaataaaaaattactagctttgtgaagaaagtagaaaatattactcataaataggagaaagattagtgaatagaaacaaactcagaaatgacagagatgatggaaatcactggcaaatacagtaaattagctgttacaaatacataaagccatcaaggaaagaatgaatgtagagagaaaacaaagataatatatttttatgaaagaactttgtgaatttaaaataaaatatttgaaatataaacttcactggaaaatactaagaacagattagatgctgcagaagaaaagatcagtggacttgaaacaatatcagtggaaaatttcttgacacaaatagaaaaggaatgaagaaagtagaacctaaattaaccataggccagtatctacatctatcatatttgtaattagagtcagaatggggcaaggaaacttgcaaaaaatatttgatgcaataacggccaaaaattttctaaatctgatgaaaaagttaaaaaaagttcaacataacggaagcaggataaatgtcaataaaaccacactagcgcacatcattagcaaattatgcaaaaccaatgataaagaaaaacattttaaataatcagaaattaaaagacacattacatccacatattatgcacatagtaaaaacgaatgactacagacatctcatcagaaaaaagcaaactggaagacaatagaacaaaatgctgcaaatgctgacggaaaaccaaactgaactaaacaaaaattcttaatagaaaaacaaacctagaagatatttctcacttaaaaatgaagacaaaaagaaagtttcaataataaaagaagtgagaacgttctgtcatcaaacttgctcttctaaataacaaattgatcaataaaaactaaataattagaaaatattttgagctgaaggaagatgaaaacacatcagattccaatttacgtgtaactacagctgtgattagaaagaaatttatgactctaacttattatataaaaataaaaacacaacagatcccaatttaggggttactacagttgtgattagaaagaaatttatgattctaacttattgtataaaaagaaaaggtttaaaatcgataatctcctctttcaccttaaggaattagaaaaagaagagcaaattaaaacaaagttgaaagaaggagattgaaaaatgactaagaaggaaatgatattgaacatagactagcagtagagaaaatgtatgaaaccaaaagttgcttccctgacaagatcaataaagttggcaaaattctagtgagagacatgaagaaaaagagaaaaatgtaatgccattaataaaagagatgatgtttatacaaatgctatagatattagaatgacaatagtggaacattatacgtaattttttgccagtatattaggcatcttagatgaaatggaaaaattccttaaaatacacaaatcactaaacattcacacgagaagaaatacagtatataaatatgcaattaacattctcctcacaaaggaaactccagatgcagctagtttcactggtgcattttatgcaacttttaataagttaataccaagtttacacaaactctttttaaaaatataaggcaggccaggcgcggtggctcacgcctgtaatcccagcactttgggaggccgaggcgggtggagatcgtgaggtcaggagatcgagaccatcctggctaacacggtgaaaccctgtctctactaaaaatacaaaaaattagccgggtgtggtggcgggcgcctgtagtcccagctattcaggaggctgaggcaggagaatggcatgaacctgggaggcggagcttgcagtgagccgagatcacaccactgcactcgagcctgggcaaaagaatgagactccgtctcaaaaaaaaataaaaaataaaaaataaggcgagtattgaccagattccaaatccagacatatatattaagaggacaaaaaaaagatcaaattttctcatgaatttaggtgcaaaacaccttaactaaataatagcaagtcaaacctagcaattatagaaagtatgatagtttgttatggccatattgggtttacccaaagattctgtgtttgctataaccttcaacaaacaatgtaattcaccgtattacactgacacctcaaaggagtttttaaaaacttgaaaattttggcaaacaataataataataaattaataggaatacctaatcaagataagatagaaaagaaattcctgaacttcatgaatgatatctgtaaaaatactacagctgacatcatgcttaatggtgaaagaatgatgctcctgcctgaggactgggaaagtcaagaatatttgttctcactccttctgtgcaacattgtggtagaggacttagccagtaaagtgggtaagacaaagaaatatatgcagtaaaactgtgtttatctgcagaagacatactgtgtacaaaacaaaaaggaaggaaacaaaaaattgtggaatatacacacaataaactattgaaaataagtgaatttatcatggttacatctgtaggccaatacacaaaattcaaccatttcatcaatgaaaatgcaagatttaggagtatttttaaaatgctgtttaaagtaacatcaaaaatccatggagtatctaggaataaatccgataaaaatgaatacctcctctaaaatctgtataatactgctgggagaaattaaagactcagatttctacagacatagacttgtatatatctgtatacaatatgtacacatggatatatgtgtgtacaatatgtatatatgcaaacatatatgtgaatgtatatatatggattagaaggctatttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaaggctatttttgtgatgtaaagtctctccaaatagatctataaatttaatacagtgcacgtacctcaaaattccagcaagttactgatgtccacttcatgttttatcaaattttttgatgtttcatttttgctatttctctattactgtattttcaaggtcattactcttttgttcttcagtgcctaatattttattaatatcacccagtatatttttcatcttagatcatataattttcatgtatttcagattctgcagtttttatttttagaaatatataacatgctcatgctttttctaccttattaaatacctgaactacaatccaggtgtcctcatcctgtgtttctgtatcccttttaattggtataggtacctaggtattgtgaatcgcatctcatttggtgctagataatcttgtattttgctaaaatattcttaagcaggttaacaatatgatcagatttgcattttgaaaacgtaaatgataaatttaatatagaagcaaatgaaaaagttttactggcctaatgaagcttacttagaaaactgttgtagtaattcaaaagagaaatgatgagttaatcagcacagtgcctgccaaatggtaacaagtggataattttttgttgtgtcacactgattctgtttaatgcataggggttagctatttacactaccctttttggtttacagaatattttatattggaaagcaattctatgctgaaggaagctatcctgaagaagaagataggaaagccagaaattaaaatccttcatattgacgactatggtaaaattttgtgcatgctatgttattcaagaacaactttctctgcgtcttatagttttacctgcaaatgactctccatctttaatattttgctctttctttaaaagaacttcctttacagttgtcccttcccaaagattttatggaccgaaaccagtatgctcttctgttaataatgtaagtattttatttgtttttaaaataaaggaatctaaagattttatatttttgtgtctcacatgacaacatttgattcaataaagaagagaagtcctatgtgtgtagttaatcaggacagctgtctgttgtctaaattcctctagaagtccatcactaaatcatgtataaagatgtgtaaatttttttgaacttcttgcatcccacatggagtttggtgctactgccaggaatagtgacactaaatagtttgatttgtgggtgtctgcttagcaattactcaagccctgcgctctttatcagttgtttatgcaacattgtggaacatgtaattccactgctaaaacaatgggttatgtttgtatcactcctattgatttttcctcctgcatgcatggcctgcagtaagctgctcctatgctcagaaaacttgactcaagtttttttcatcttgaaattgactttgaagttaaatatctttatacattttgtaaggctatatcatgactatatagtattaggcaccgaggcccctaacatctaatgcgtaactaacttgatattgatttagcattgtattcctgagagttataagttatttcccttattaatatgatcaggtagcatattgatataatagtgcttaaaacagtctaaaattatatctttagatacaataatttcttcagatataatatttagaaatagtaaatatgaaaataacattgcttattatgatcactgagtatagtggataagtattcagtctgtggaatcggatttcctgggttcatattctagttttgctatttattagctgtgtgtccttgggcaagttccttaacctcctacaaggctaagtttctctaaatataaaacaatcattacaatacaacctgtgttttaagactgctttgtagactgagtgaaatacaacatataaagtcccttaaacagtgcctaacacatatgattcttataattattgcgattataattcttttttgtatagactgcatttattttatttagatattttaatatatacaagcaatttgtccctttattttaacaaaccacataatacagaaataatataatatttaattttctctctcactctagtgttcatttctaattctaattattgagctttatatagtttctcatatccaaacttttctcccttgtccctaaaagccagaaagctctgaaagttcttaatgtctccttgaggaagttcttatttgctgtttcttaattcattgtttttttttcttgtcttttttacctagtttcttctggtctattttaactgtatgtatgatttactgaggaaaaatgtttaaggcactaaaacgagacaaaaagaaagcaaaaatcaaacccatcttctatctcagtcacgtctccctttggtaaaaggaaatgttcttttgattcactgaaaaataaactttctcaaggaagggacatccctcaggcacatcctaggcatccctcagtatgtgatgaccttcaaaatggaagataaaagaactgactgcccttgaagcatgatatttatgcagacgaatgtgtagataattatgcccacttgcgtatccacctgctgtagggcagtgtcacacatagggggaaaaccgaataagagttaacagaatctctttgttttctgaaacagataagctaactggctcatcttggcatcagacttgtgttttgttctggttgatttttagtttataagaggaatataaggacctacacaagaaaccaatttgaagacttctcttattggcaaggggcacttggggttttttttgagaagtgggattttggagcaaaatgctggttttggagtcaggtaggactgggttcaagttggagtgctgagatttaacaatacactgctgaattttttgaatcttctgttgccttataaataaattggggaaaataacatgggataatatttctatttaaatatattaccatagtttttggtagagcataagcacttgcagatagtctttaataaatcataagcagaattataattattattagtatggtgcaaaagtaattgcagtcattataaatggcaaaattataagtaattgcattacttataaatgcaaaaactgcaattgcttttctgccaacctaatatggataatagtattttaaagtatttaatgtgattaatataaatatttaatgtgtaatttaatgcccataaagttattcaatagacagacactactaaaatagataaaatagtgccgtcagacccatggaatttactttgctacttttttggttgatacaggaagaatgaatgaaaatgagtataaaatcatttctagttatactttgttatatatagttatatattgtttatactaaatattaattgacattatccacacttttgggttttagagggaaattatcgaaagcgtcacagaatgtgacttacaaaatccaaaaggagaatttctttttttttaaatttatacttacaatatgatctattcttttaaattgcatgattatttctaaaacactatgcttgaaaacatataagggtcagaatagcaaaagtagaaagtgttttttaagaattttaaaaactgcccatgatttaaagccatattttttctcaagcttaaaaactgttttcagtgacaaattgacttcccattctaaaagtaataataattattatttttttcgcaaatgagcaattagacagtgataaacaatagagcgactattatttaaatgagtctaagaggtcattcagtgattttggtgtcagtactttattgcaattttgtgccatatatctggtagccaacagaatatgagccatttcttgatctgtagtgatgggtttacatccaaggaattatataatgaatgcatgagttagcgtcaggctgcagcaagcacctgagtggctgaaagaaagactgccctggaagaaagtggcctctggcaatttggaaacccagttctgctcaatcttcattatggatcttcaaaagaaatggtcctctgacctcccttgcttggtcatatgttttgaaactcaaacttaatctcgtaacatttaaaatgtaagtgaatcaaagatcaatgtcaatgtcacattaaaaagagtatgcgggatggagtacataccacattaatatttttactgtagaatatttttaccataatggaaaaatctaagaagcattggcaccatagatggatctcagtgacctgagtttgctgtggtctctacggagtcatgatcccctttttctgaacaactcctccaattctcccttcaagtgcctatttgttttactcctgcctttctgtttaacattatagggagcccttaaggacccggagtccttattcatttttaaacttattctatacacatctgtattcattccagctcttataacctcgtattgttcttttttaatattattcttacttcctactcatgtttatgtaatttaataccatacacgtctaccacattgcttttacatatgagaagccgtgttaatggctatggggagataacaagattgcaagcatcttgaagtctataatagttatttgggtttgttcagtctatctccgcaatgcctaatacacagaacttactgactatcctgtaattaccaaatagtgccaagactgaaggtgttgtggaaaatgccctgcacttgcagacgttcatttggtaaacaaacaaatatgaatctaatatacttagatgctgataaaagcaatccagaaggttgtactgttatttaaaaagaagggatttttgtttttgtttttattttctgtccctctgaagaggagcagcatcagctcaggagtttatttcagtaccaagggcccgtcatctcttcccattttctactttttcatgctcaagttatcttgccacactcgttaaaggtctaataagggaggcagtaaatgttcaacagattatattaacttccagaatgcaacatatgctatcttgcctccatgactttctttcctttctctgaattcaccttccttgaaatcccaagaaattcatggtcatccatcaagtcttatcttcctggagctttcttccattctcctcctctgtcagcctatggatcaggtcattctaaccggagagcattattcatttttatctagagtctcatcactgaatgttctgtgtatcagaatcctataattgggtcatcttggtagaagtgatctgttttctatataagtattctttcaaacagcatgatataagtaactgatcattcacaatgagggaatatattcagttattcatatccaacagtcaagataacatcattgctggtttgttatacacacatttcatttcctcaaacaacttgaaatattgtttaatattttaattagcatcaagcttcagacaagtcagacatcctatctggatgactgaactctaacctgctatactattctctacttacacttcctttctttagtttattgctttttgctctctctctcttttagttgcttttccactctgctgctaggttgaacttggcaaaatccatatctgagaatgtagccctcctatctaaaatcttctcattattcattcatcattgattaaagctctgcgttttccctcacactacgtaacagtcttcatgatatattttctatttttctcttcgtttttatctcacatcagccacccccaaagagaaatcccatcctttagacagactgctttgttctggggaacaccaccacttcaatcatcacttgtgttttcacatagcctcccagtgccctgagtttgcctgcccacctggagaagttctcttaagacttccagacacacttccagataactttatgcacaccgctattacaaacatgtaaccataccagattacaacatttactttgctttctctcctgttaaactgccaattccttttgaatagttttgccataccgcactaactggagcattatttgatagaataaatgaatgaatatatgaatacatcaatgaataagtaaacaaatcaattaaccctgagtttgtcctcaagaatgaattaagtcgagatggagaaatggagaaataaatgatttgtgagtttataattgatttctgtatgggtccatttctctgcaatttagttttgtactcagaatgagacgcgagtttctaatttctcttatagtctttctggatagggctgaatattgattgattttcatgctgtctcttcactgtttctttttacaatttttttacttagcttaagataataagaattgatattagctaccatttattgttattgtgcaaagagtgtcttgctgagaatatttagacatcatctttagtccttatagaaatcatccaaggtgaatactactgtcctcatgttaacacaaggaaactataactaaaataggtcatgtatgtgttcccccaagttcacagaaggaaaagttaaggtttggactcaagttttatatatctattttctgtattaaaacctctgctgtattacccaatgctgcctgcctacatagtccaccgtattatgataattattggcatattatcaaagaatgatgacttgaatcagaagaggcttctctactgccaaattcttatgaacttttcttctttccactgaacagtttataatagtttctggaatataacattttccacatgtactatgttaatgctttggtgtaaagtattgattatacaaatcatgactgagttcatgaatattccacaagagagatcaaattctcagctcagattatttaataaaattctgaattctcatcaaaatgttcactttgtgggaagtcttttctactctgtatttgtttcatagattcctagggttttcgcagatcagattgtgagaggtgagttcattttgtttcccaaggatgaagacatatatattccaataacttccaacatcatttgatcttctatttgttcatgccaaatacacatctacttttaccctcagtttcttgcaaaaatagtacatataccgtctgatgtgggtgaaagagatagcttgttgatattaatgtttgtctcaaagagggattattattgctttgccatataatgaggttcaaagcttaaattttaggtttatcatttttgtatctttgtcatttacatggatggagaatgtacccacactgtaatacatagaaaatgactaagaagaaaaaaggcagtggcatttaatcttgttaatagaaggggagaaggtgatcatttgtttctgtttttttcttgaacatatttaaacttgttctttcacaatttgtagataatgcatcttaaatgtcagcattaacttcttaccactatttaaagttgtacaaactcaaacttgctgtattaagaaggtgacatgggggaaaaacccaaatttagataaatttatagataatgcctaagctataatatttgtttggtgtttattttaactggaatatatatatatgtgtatatatgtgtgtgtgtgtatatatatatatacacacgtatatgcacacacagaaacacacatgccattttaggtcttctgttaacataggttttagatatgcatggattcacagaattatatgaatgatataatatggtttcatatgaatgatatgggcttattaatagttcctatttaaaacttacatgtatatgacatatttacagatacactactgaatactttttataagaaatattgaacttcgtaatttacaaagttcttagttttagatggtcatataaatgtagtcattaatgtaagggtaattcatattgaaatcagtctctttttctgttttaattagttatttgtttttaagaaaaaacatattaggatataagattaactatattattagtttaacatgactttgaaaggtgaagttaaaaataccaagatacagtgtattctttcttggtaatcccacacatctccacatcagaggaatacatcaatgacattatgttattccaggattttttaaataatatattctttccttttgacttatatataaaaacagtacattatgaatcatgtaaggctgtgtagcatgtaagtcaaagtgtgtctatgatgatgggaggctaggccagagctccaggcttttctagtccaacatacatatatttttgagcaacaagtaatgtgcaaagttccctactaaaaattacagggcttctaggagatataaaacttgggaagaaactaataattattgtatttttaaaagaaaaccacaacccaaataatacaattgttattaatatagtaaagttttaatcaacgttttgatttggaatcattcagtcattttcagcattggactttagcacttgttcttcctcttggagggcattctcttatagccgttttttctcatttttagcatgccattttaatcaaaattataaacctgatctagctgtagccttcttcattaatccactatctgagtccatgtctttgtagcctgtatgattagagctctcagttgtcacctgtccctcagtaacatggaggaagcataatcaattggaagttgctagatcagccacaactcaccctaaaaaagtgcttccgttgatttttagcttttttattaaggttccaatatattgctaagactttttccttacttataagaaaatgtggctctgatttcctctagacattaataccttgggaaaggctgtgtctgcgccactatgacagtgcattatactgacataatctccctgtttttcatcacatagaaaacatgtcatacaagataaatctatgttgcacaaaacatgctgcatctttgggaattaaaagtgttgaaaattatattgatacatatatgttaatgtataggttatatatattttaatttataagggcacacaaaaaaagtccatctatataacatgtagtttacacacttcctatgcttttattttttctttttttattaatattattatactttaagttttagggtgcatgtgcacaacatgcaggtttcttacatatgtatacatgtgccatgttggtgtgctgcacccattaacacgtcatttagcattaggtatatctcctaatgctatccctcccccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcaccattttttatggctgcatagtattccatggtgtatatgtgccacattttcttaatccagtctatcgttgttggacatttaggttggttccaagtcattgctattgtgaatagtgccgctatgaacatacgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattataactggtgtgagatggtatctcattgtggttttgatttgcattgctctgatggccagtgatgatgagcattttttcatgtgtcttttggctgcataaatgtctttttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgacagtagtttcttttgctgtgcagaaactctttagtttaattagatcacatttgtcaattttggcttttgttgccattgcttttggtattttagacatgaagtccttgcccatgcctttgtcctgaatggtgttgcctaggttttcttctagggtttttatggttttaggtctaacgtttaagtctttaatccatcttgaattaatttttgtataaggtgtaagggagggatccagtttcagctttctacatatggctagccagttttcccagcatcatttgttaaatagggaatcctttccccattgcttgtttttgtcaggtttgtcaaagatcagatagttgtagatatacggcattatttctgaggctctgttctgttccattggtctatatctctgttttggtacgagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaaacaattgtgaatgggagttcactcatgatttggctctctgtttgtctgttattggtgtataggaaggcttgtgatttttgtacattgattttgtatgctgagactttgctgaagttgcttatcagcttaaggagattttggcctgagacgatggggttttctaaatatataatcatgtcatctgcaaacagggacaatttgacttcctcttttcctaattgaataccctttattcctttgtcgtgcctgattgccctggccagaacttccaacactatgttgaatgggagtggtgagagaacatacctgtcttgtgccagttttcaaagggaatacttccagtttttgcccattcagaatgatattggctgtgggtttgtcataaatagctcttattatttgagatacgtctcatctatacctagtttattaagagtttttagcatgaagcgctagtgaattttgtcaaaggccttctctgcatctattgagataataatgtgatttttatctttggttctgtttatatgctggattacgtttattgattttcgtatgttgaaccagccttgcatcccagggatgaagcccacttgatcatggtggataagctttttgatgtgctgctggattcggtttgccagtattttattgaggatttttgcatcaatgttcttcaaggatattggtctaaaattctctttttttgtagtgtctctgctcggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgctccaatttcggagcctgttattggtctattcagagattcaacttcttcctggtttagtcttgggatagtgtatgtgtcgaggaatttatccatttcttctagattttctattttatttgcatagaggtgtttatagtattctctgacggtagtttgtatttctgtgggatcagtggtgatatcccctttgtcattttttattgtgtctatttgattcttctctcttttcttcattagtcttcctagcggtctatcaattttgttgatcttttcaaaaaaccagcttctggattcattaattttttgaagggttttttgtgtctctatttctttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctacacactgctttgaatgtgtcccagagattctggtatattgtgtctttgttctcattggtttcaaggaacatctttatttctgccttcatttcgttatgtacccagtagtcattcaggagcaggttgtttagtttccatgtagttgagcggttttgagtgagtttcttaatcctgagttctagtttgattgcactgtggtctgagagatagtttgttataatttctgttctgttacatttgctgaagagtgctttacttccaactatgtggtcaattttggaataggtgtggtgtggtgctgaaaagaatgtatattctgttgatttggggtggagagttctgtagatgtctattaggtctgcttggtgcagagctgagttcaatttctggatatccttgttaactttctgtctcattgatctgtctaatgttgatagtgggctgttaaagtgtcccattattattgtgtgggattctaagtctctttgtaggtcactaaggacttgctttatgaatctgggtgctcctgtattgggtgtatatatatttaggatagttagttcttcttgttgaattgatccctttactattatgtaatttccttctttgtctctgttgatctttgttggtttaaagtctgtttcatctgagactaggattgcaacccctgtctttttttgttttccattttcttggtagatcttcctccatccctttattttgagcctatgtgtgtctctgcacgtgagatgggttttctgaatacagcacactgatggttcttgactctttatccaatttgacagtctgtgccttttaattggagcatttagcccattgacatttaaggttagtattgttatgtgtgaatttgatcctgtcattatgatgttagctggttattttgctcattagttgatgcagtttcttcctagtcttcatggtctttacaatttggcatgtttttgcagtggctggtaccggttgttcctttccatgtttagtgcttccttcaggagctcttttagggcaggcctggtggtgacaaaatctctcagcatttgcttgtctgtaaagtgtttttttctccttcacgtatgaagctcagtttggctggatatgaaattctgggttgaaaatgcttttctttaagaatgttaaatattggcccccactatcttctggcttctagagtttctgccgagagatccgctgttagtctgacaggcttccctttgtgggtaacccgacctttctctctggctgcccttaacattttttccttcatttcaactttggtgaatctgacaattatgtgtcttggagttgctcttctcgagcagtatctttgtggcattctctgtatttcctgaatctgaatattggccttccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttcatgcttcatttcattcatttcgtcttctatcgctgataccctttcttccagttgatcgcatcggttactgaggcttgtgcattcgtcacgtagttctcgtgccttggttttcagctccaacaggtcctttaaggacttctctgcactggttattctagttatcctttcatctaatattttttcaaagtttttaacttctttgccacgggttcgaacttcctcctttagctcggagtagtttgatcttctgaacccttcctctctcaacttgtcaaagtcattctccatgcagcttcgttccgttgctggtgaggaactgcgttcctttggaggaggagaggcgctctggtttttagagtttctggtttttctgctctgttttttccccatctttgtggttttatctacctttgttccttgatgatggtgatgtacagatgggtttttggtgtggatgtcctttctgtttgttagttttccttctaacagtcaggaccctcagctgcaggtctgtcggagtttactggaggtccactccagaccctgtttgcctgggtatcagcagtggtggctgcagaacagtggatactggtgaaccgcaaatgctgctgcctgattgttcctctggaagttttgtctcacaggagtacccggctatgtgaggtgtcagtctgccccttctggggagtgcctcccagttaggctactcgggggtcagggacccacttgaggaggcagtctgcctgttctcagatctcaagctgcatgctgggaaaactactactctcttcaaagctgtcagacagggacatttaagtctgcagaggttattgctgtcttttgtttgtctgtgccctgcccccagaggtggagcctacagaggcaggcaggcctccttgagctgtggtgggctccacccagttggagcttctgggctgctttgtttatctactcaagcctcagcaatggcaggcgcccctcccccagcctcactgccaccttgcagtttgatctcagactgctgtgctagcaatcagcgaggctcggtgggcttaggaccctcccagccaggtgtggggtataatctcctggtgcaccgtttgtgaagcctgttggaaaagcaaagtattagggtgggagtgacccgattttccaggtgccatctgtcacccctttctttgactaggaaagggaattccctgaccccttgcgcttcccgggtgaggcgatgcctcgccctgctttggctcacacagggtgcgctgtacccactgtcctgcacccactgtctggcactccccagtgagatgaacccagtacctcagctggaaatgcagaaatcacccgtcttctgcgtggctcaggcagggagctgtagactggagctgttcctattcggccatcttggctcccattttttttttttttttgagacgcagtctcactcctgtcgcccaggctggagtgcagtggtgcaatcttggctcactgcaacctctgcctcctgggttcaagctattctcctgcttcagcctcccgagtagctaggattacaggtgcccgtcaccacacctggctaatttttgtacttttagtggagatgggcttttgccacgttggcctgactggtctcaaactcctgacctcaggtggtccgcctgcattggcctcccaaagtgctgggattacaggtgtgagccgccgcgcccggcacttcctgtgctttcataagaacttgtactctcaccgcattatgattacaacagggcagatattctaatccccgtttttgcaggtgagaacccttgagggacagaactgatgagcaatatgcctcatgttggacaactactaagaagtgaaaactcagcaacaatgtgccatacaagcttttattacttttccctaagaaaaaattctagggataaaggaatttaaaatacgtggtgtaaattcagaaaaagacccataattagagcttaataaataaaagagattttttaacaccttaaatttataatcttattctggctaagaattccaatttccttttgccttgaggatataattgcttatatgccaaaggtataagtgaatattttgttgaggtcaacttttataattgtgttctctcaaaaaactggtgttatttgtctatctatggtttataatttctttaccgctatatgtcggtttactaagttgcaagatggttctgccactgcctgcttatacttagtactataatcattattattcctatttaactgatgcaaaaactcagctaaggtgtaaaattccctatgtttatataaccacactttccagttgataaatggatttttagaatgcaggtaaaggattatatagttagaaaaccagtattgtatcaccaccatacattactgaaggtgtcatgatgccctaccaaggatgaaatacaggttgaaagttagtaataattagcatccattcctgtattatcaacccattgcacacatatgtatccttcgatatgtagcctatatgtattgtcagcctcagtacgtactcactacattcccatgctgaattgccctctccttgaaaaaatacagaaatttaagtttgttgtggagattgtcacctgcttcttttttaaagatacacacactttgttctattttttatctaaattgcccccccacccccagttcctgaagcaagcatgtagaatattttccatgatcatatccaaagtggacctgctgcataggagagtcacattgcagttatgtgcacgtgaaaactgagataaattctcctgtctttggtgtgtttataaaatgtgctaagctttcttttaaccatgaataatttaggtatgaccctttctaagtgcaagagaatagatcaaatgctatcctagctctgtgatgatatagctattcccagcaactgaaagaaaagatcatcaaagcctcttacctttctacttactcactcacactgttagaaattatctcaaatgaaaattggccaaaggataagaattaatgtactaagactttgacagcaaatatcattaggagattgtacattccttctattttattgaacaatttctggctaggagatgtccctgaggtccttttctattggttgtattcttatattttcatgtgctgtccaagatgtttatcctgaggttaattttgtgtggataatgctaacagtccatttctgagttttagagctggctcattaatatctatgctgttcagtgtttcaacttgtgtaacaataaggctttcagtttttggatttgtactacagtacgcgtaactgcagttaaacaactggactctgttttttcttcattactctcatgatggtcattatgcagtttttgcatcaggctaaggagacaatctctggctttcattcaagataaagagcaaaatagtatcaaattcccttcaagacaaggaagagtgcctttggccgataatagttcatcatgacataaggaaaactatttcattaaaaatagaagagagaaaaaagggacaagtaggaggaaggctaggggagagatccaaaaaaagattcaattttattaatgcaaaatacccaaacttggagatcaagaaaaaaaaaaacattaaaacatcaaatatatgtttgggttttttttaattctttaaaaacacgaaaaattctgattgaggaaaaacattaaatgcatttttcaggtttatctgaagtcacagataacaatgttaatgaacagacccacatatgaataagtgaaaagacttaagaatgttttctttaaaatcaaactataactgagttcagaggcactctggattttagcaatttaaaagcaatcactgctactaatctaactatgaagaagctcgtaagatacctttaacatatggataataaaattgcaaaagtgccagacacgtgttcgagagatacacgctgagcagcatatacgtgtgcgaaaggcacaatatttcttttccatttgtatggccgtgtaactataattcaagccagcgaagatttatttatgtgacataaagactactagaataataaagagatttttaaattatgtgtatttgtgcaaatagactagaggtcaagaatacttcgatgacataaaaccaccttccctgagaaacgatgttcttgaatgagagtgcaggaattattgatgcagagttgcatagagatagtcagatttgggtggctcagcttctacaagaggaatggaaggtgtaaggtcaagtcccaaagtgttgtccagaactaggttaataatattgaacacctataccaaggaccaggcactttacgcagctacatatagaatctcatttaatccctgccataactctactgggtagatgctattatcaccctctataccaaattaaaagcaaacgtaggcataagtgtctaaagccactggacctgggctcaactcagtttgatttgatccccatatcacctgtaccttttcacagtgacatgcttacttctttataaagtctaggtcatgaatgcaggcaacctttctgaaggtttgacaatggacaaagtctgagaataaaaatagatgagtacaagtgatttggaggttagtacaatttgagaatttaatttatgaacagaattttttatacattatcaggtagccttcatcataatcaccgccagaaagaaaaatcttagaactaggagatagggtcttggtagcggcatgaacaaccttgatcgaatcaactgctttcctggttatgacttataaaaaaaggaattcaaccaaaagctacactgtaaataaactagggtgaggaatttgaagattatcttaacaatatccctaatggaagaagatgggaatgtggacaagaaacagttctctggtaggaaaaaaataatgtaattccttacatgatgaagtaaatacagtgtatgagaaaattcattcagccattcttcatgtaggaaaatccatctatgagaagaaatttaaaaataataaagagataaatagaaggaattggcccaagaggcccttagccaatatgtggatctatgtgtacatactgcttgaaagagggcaaacttcattatactttagatacacatatgctgcaactaaatcatcatggattataaatctctataaagtaaatttttaattaaaccaaggcaaatattgtttaaagctgctatcctatgttaatctcatattctacctgaaatgaattgtcatgaagaataaaatggaagcatagatagttgattatgcttcagaatataaggtaatattgttctttgcatattgtttccttttccttaccttgatttttattctgttctttactcctcctttcacattctttttaaattcataatacctacaattaaattgcaacccttggttctcaaggattctagctttcaaacaggtactcgtgcaactgagcgaacctgttgtaggcctagaaagagcaatgaactgagatgactataaagcagttctctctatgtcccctctttccactgccccagtggacacaggtaagcagctgacaaattctgccatgctttcaactggtcgtcagaagtcctctcgttagaataatattcttccttccatttattataactaaagctttactgataaggataagagctttcaaaaatgtacttttaatggggtgcggtggctcacgcctgtaatcccagcactttgggaggccgaggcaggcggatcacgaggtcaggagatcgagaccatcctggctaacatggtgaaacctcatctctactaaaaatacaaaaaattagccaggcatggtggcgggagcctgtagtcccagctacttgggaggctgaggcaggagaattgctgaacccgggaggcggatctggcagtgagccgagatcgcaccactgcactccagcctgggcgacagagcgagactccatctcgaaaaaaaaaaaaaagtactgccctgataatttgtgatcttaactatttaccaccaaatattacttaacaatgaaaacaataaataaaaataaaaaaaccaattaattcctcaaggtacctcagcagattggtaatgaaatcaaggactaaaaccttagtcttctgtatataaattcaaccctctttttagaatttaattgaaacactttgtgaacccgatcaaacatgtagtttgaacaaatctctatactttaatccagttttggtataaatgatgttttttatgtcataaagaggtgacttgttctgtcatttaaaaaatctattgagtattgtttgttttattccattttttctatattttattatattgtgaactcatccatacagacacattcagtgttgaaggtattgaaagagatgaggattctgccctcaaagaccttaacttctaagaaaagtttgcagtcttaatttgattctgctacttgtgttaggaaatagacaagtgtcatattgctatgaccttttcactgcttaaaacagatggaattgttcttttcaccgcaactttcaacaaagttgtatgtccccactctcaaccttgaaacacccttcttactgtgaatccccaaagatttctgagacagagataaaaaagcaaaattgtgtagaaggcaaatgagggagacactcagaaagaaacaaaaataactaaatcaattggagctcagcaatcttgcacagccaatacacacatgagtcgtggtacccatttattataagatagatgatttgtctttagtacattctgtgtggttatccctagcaccaaatgttttgctattcctattttactgaataagcactctttgcttagctttatttataagtctagtattttctgctcaacactttgtgaacaagtaatgtccctcattttcctgcacatgcctgatttgttccttataatgccaatgattagcatcataatccatgttcttttaagtgtatgttgaaatagatatgcctatattgtgcaccaaagaaaaagaaacaacacccaattagatcacagaaatgggttcaaaaatctttggttcataatgaattgataccacttcgtgatctaacatttaaaccttggaaagactaggttaaagtttaaaatggcaattaagagaagagagcaaaagagtgaaattgtagttttcttctatgagtgtagcaataatgagtaaaggattgaaggatttgttttaaaaaacctgttgccatttactaattgtgagtttgaaaactgtgccttattttaaactctatcttaaaataatttacttgcctgccataaaatgtctgacttatttacattttaactaaacatatcttagctgggaacttctgaaatcgctgtgaacaaggcaatgtgtcatacgtagattggaaagttatatcttttaaataaacaaaacatcttatgttgccttagcactgctgccagagtttataaaggtgaacaatcctgccttaaaagttaaggacactctggtgatcactccaagggtctgttgattgcactttttttatatccttgtaaggctttagatttcattggtccatctagaaaatgggattacctctgacataagagctcatattacatagcaattatgctttatccatagatattgtgcatttaattactgtacaactagccgaaattctttatatagttctccatttttaagtgtaactcaaagaaatatgctcaacataagcaaaattttcttcaagtaaaagaataaaaaacagttgttattgtcctataaatctaatcatggttttgttcattatacttcataaagtattttcaaatgccttatgccattaatgcttacaaaatgtctttgaggaaaatatggtagtattggccatcattatagacacagactgagtcctagtgtttcagttatttttgcctatgttggtagtaaagttgagattcaaccttggtatttttactcagcttagtattcaaaggtgaagttaatctttggtacctgttctctgtgaatcaaaatatttgcaataaatccacaagcttcaaaatgcagtatctttatgtaaactcaagtctttttaaggcctttccattttaaacttcatctattttccctgaagaaggtctacttcaacaagcattggctgtgtcctatgcatactagaaattatgctaggcatgattcgtgctagttctcaaatgttaaacaagctgtatcaggatcaactgggcaactgaaacaaacaaacaaacaaacaaacaaaaaacagcaattccaggcttacttctgaatgaagacatcagacttctaggttacagcatggggatatgggtagtaataaatttcaaatgatctgatcaagagccaaggttgcataaattaaaatacatttaaaaagaaaatataaaagaaaagagaaaatatctaggtggcaaacactgtggaaagacaaggcatattttgatttgaatcactgaaaatcacattaaatgagtgatttagaaaagaatggaggagagttgtgattcattaatttctatggcacagtttatttacggtgtttctttatttataatacatctcataatccacataatagaaaacttactcccaaaaagatttactaaactttggaaatatggagtacatgacataatggatcttaagtgcttagaccacagaaggcatttatattagtttgctaggaccaccataactaaatatctctgactggatatctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctgactggatatcttaaacaatggaaattaattttctcacagcgctgaaggctagaagtcaaagatcaatgtgccagcaggattggttatttctgagggctctccttgggttgcagacgaccgccctctttgcgcctcttcatatggtagtcccactgtaactgtgcacctctagagtcttttgtgtgtgcaaatttcctcttctttaatgggcaccagtcagattgaattagggcccacctttgtggtttcattttaacttagttacctttttaaaggacctatctccaaatatagtcacaatctaagcaactgggtgttagggattcaacatataaattttggagaacataattcagcccctaacagcttttaataaattttagttgctctgtgttttgtctgattctctacttacttctttatgtcacttacaggattccacacaacccctgtatctgctcagtttcatttgttgctgaaaggttatttgctgtaggaaatctgataacttgaaagcttgttattggagatgatttgtgtatttggggcttctagataaacattcacataaagaggaaggcgggagagtttggtgtttttaccttgaagagtgagtaggctgggaatttctcacaggttgcccaactaacaatggagatcctttcagggttggatgtttaaatggtctgtaaatctatcacatgcacaacttcctattggaactatatctaggtatggacctagatattctatgtgattgtttcagagtctgattttttactttttctgtattctagaaaattaactaataaatattttaagctgacattttaaaattgtaccttcttttccctgtggaaagaacattcatgctttattatttatgtgtctttctttccttctagctttcaagtttttcaaacatatatatctatgcttctttctgctgtcaactttagtgataaaaaagaatttttctcactgcttgtttaaattttcttcagtgagaattccaccacagaaacaaacaaacaaaacaattcaggaaatactaatgcagttttttttttaagtttaacattatgtatggttgtacatttcctgttaaattattatcaacttttcataactggttctgcccttcagcccttggaagccatttgcaagacatttctaaaacactatggaagaaatccagtaaagatagacttgtctaccaacttgacagtcattctttagaaatgcctttgggagagtatcatccattttcttcatttttccccattgagaaatgagctaaactaatttctactgcaatgttaactcatactttcatttcattcagggaacttttcaattacagttttacaaaggaaaatacaattttacgaaggaaaattgtaattttaccttcaggtttattatcaagaattaacagaaattttaatagccagcacagttctttcccattacttaacttgtgagtatgaaaggtaaaatttctaccagattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaagtaagtggatgcacatttttcttctctgttttctataatgacagagtcttggtatatgacatataatattactaaccctgactcaaggcttctattttagtgattgagcaattttgtaagttaatcataaagcctatttcattttttttttgaagtacctgtcacccttagtgctataataaaagaattctcatatttcccctctggaattaaaatttactttggatttatggaagttggatacattttaattataccactatattatttgtttacaggaatccacaatgtctgttgtatcctcagttaatcacaattcttgaagtttcacagataccattatcacactggcatgaatgtgtgacctaagaaagttagtgggttctttataatagcacacagaaaccagatatgatattgttcaaatgtagatgttgattcagtaggcctggaatggggcccaggcttctgcatttataacaagctttcaggtgataccaaactactaggccatcactttgagtagcaagattttggagtatatgaccctaatacatgaacagagctacagttagtaaagcatttctagtcattagctattgttttgtatgtatgcatgccaactatatatttatatttgcatttaactcacaaagatataactattgtttttcgttttcattgcagatttttgctgaaactgccttacattgactccaaaagattaagcatttttggaaaggtaaatagtagaaatgctgaatctatctttttatgcgtatctatgttatgtaatatcctattacacattcacaggaggccagttggttacagataagttccatattgactgggattccatacttattaacatggaaaacctcactgtagcaagatttgatggcagaggaagtggattccagagtctgaaatgtatatatataatatatgtatatatacatacatatatgtattatttgtatgtatacatatgtaattacatgcttcattatattataattcctctgtattatcctttaaaaaataacataattagtattatatacagtcagtcatttattaattcagtaactatttattgggcagttagttggcacctggtgtcagaagtagaacaacaacaggacaaaatggggctttgttttcatgaagcttgtgttccagagaggggaaacagtaaagaggtaaatgaaaaacacaatttcatatagtaataagcctcataaagaaaacaaagaaaaactgatacataaaagctaactgcagaagcgcggccagtgtcattagattgagtggtcaatttaggactctctgatgaggttatatttaaacctatacctaaataacaaatggacgctggtcaaataaatctcttgaagcagaatattctccacagaaaaaaactagcaagtatcgcaatcttaggaaaacagacacaggcttagaaactaggaaatgaccagtgtgcataattacgtcatctgtgctctctgcacgatatttacttattgcagtaactgttatgtcaggttcaacattattttgacagtgggaaaatagacctcatatagatatttattagtttgttttttatttttgttttttgttttgttttttttttttttttgagacggagtctcactctgttgccaggctggagtgcagtggcgcgatctgggctcactgcaacctccacctcccaggttcaagcgattctcctgcatcagcctcctgagtagctggggactacaagcacgtgtcaccacgcccagctaatttttgtatttttagtagagacggggtttcaccatgttggccagatggtctcgatctcttgacctcgtgatccgcctgccttggcctcccaaagtgctgggattacaggtgtgagccaccgtgcccagcctattgagcttgtttttaacacatcagtggacaatgtattataaaggtaaaaaggccaggcgcggtggctcacgcctgtaatcccagcactttgggaggccaaggcgggaggatcatgaggtcaggagatagaggccatcttggctaacacggtgaaaccccgtctctactaaaactactaaaaattacccgggcgtggtggcgggcgcctgtagtcccagctactcgggaagctgaggcaggagaatggctgatcccgggaggcagagtttgaagtgagccgagatcgagccaccgcactccagcctgggcgacagagcgagactccgtctcaaaataaaataaaataaaaagatgaaaggaaaagggggaccttgaactattttagtttacaaataaagcaaattcttggtgttcatggatttaaacatatgatattttctactattcataagtaacctagagatccatgacataaaataactggtaagtttaattggggcgtaaattttagtggtacatactgacaggtgggtgtataaaaaaccacttaagaaatgagtaaaatacaaatcagtgcaaatcacgaccatcctctctccacttcaaacatctgcagtgtatcatgcctttgcagcattctacacttgttgtcagcaatattcaacagataagtaaaaatattttgtgagcattgctcctccaacataacacaaagaagtaaataactgaaagtgcatccctagtagtaaaggttagttttttgtttttttttttaaaggaaaacatctaagaaagtgatcatcccaaagaaatggaaaccctagatatattaaaaagtgaaatgaaatcctgtctcagactgcagcactgttaagccttagggacattgtgctaggtgaagatagccagtcacagaaggacaaatactgtataattctacttattacatgaggtgtctagagtggttgagttcatgaaaaaaaagagtgaaatggttgttgccaggatttgaggggagaggaaaaagggaagctggtttttaatggatatataataatggcaagaatgtaaactagtaaagtaaaaaacaaagataaatagagaacaaccaagccagaaaatacagttcattgaaaaaaaagagagggatggaggggtgacaaaaagggagagcaagagcagtaaaggaagaatgtgagtgcaaatgagagcaaggtgctctttagtgattagccattttatgagcccatcagtttcttattagggttcttggaatttttgtctagtttcatatttgcaagatgaaaaagttctggaaatctgtttcacagaaacaaatatatacctgacactacgaaactgtgtgtttaaaagtagttaatagagtaaattttatatgttttaccacatacaaaaaagtacatgcagtagggaatattttactccttaaaagtcctgatacatgtaataatttacaaatggcttagggcctatgtatttcaatgctctgcttactgtacacataaataagcataaaggaccaaataagcttttacaaacattcatggaaatttagagaagattcaaagggttgtaaaatgcctcatggaaaagggcaacatgagctgagtggtgatcagcaggtagaggggaaggaaaagagtctcatgcaaatgcacagtgtcagtgaagggagcatgtgtggagaacatgaaatgaagtagttgactgttattagaagaatgataggcaataagaatgagaggaagactgggccgagacgatagaggatcttcattgccactgagaaattagaagctcagcatataaaccatggaaaaataacactctaggcttcacatttagaagttcaaattctttttccccaaatcgtcattgtatacttgatgtgcctcagagcaaatgactctggaaaactaaaagagtgacataggatacaaacaagtaaaaatatgaatgacttcatcttaaatggaaaaaatattccaggtcaaacaaatatgcatatctgtgactgagttataaattaaaagttgactttctcaccatgtaaaatacactgtttatcctaagattccgtagaccttgcgattcttttttcttgaaatgcactgatttcagattcaaattaggttatgctaacctcataaaacgggttggaaaacaatgttcttgctatactgattccctggaaaaatttgtttaaaattggaactagactataaagaaatttggagctattgctttctgtgtgggattaaacatttaattagtttttaaatttatgtaaccaatagaagactattaagattttgtttaatttcttctgaggtcacctttagtactttgaaaagaatattttttcacttcatataacttttcaagaatatatacaaacagcaatatataatatcctcttattatatgcttaatcatttcacttgtggcagtaatatcccattttgatttctattatgacttactagtgccttcttgcttttgctagggcactctcttgctctcatttgcactcatgttcttcctttattgctcttgctctccctttttgtctctcctccatccctcttttttttgttcagtgaactgtattttctggctggttgttctctatttatctttgattttactttgctagtttaccttcttgccattattatttttcttctactttttatatacattttttcatcaattattaagttgaatgtctagcttattaatttttcattctttctttcaaatacaagcacttaggctgggtttggtggctcacacctgtaatcccagcaccttgggaggccgaggtgggcggatcgcctgaggttgggagttcgagaccatcctgaccaacatggagaaacccctgtctctactaaaaatacaaaactagccgggcatggtggcacatgcctgtaatcccagctacctgggaggctgaggcaggagaatcgcttgaacccaggaggcggagattgtggtgagccgagatcggaccattgcactccagcctgggcaacaagagcgaaactctgtctcaaaacaaaacaaaaaacaaatataagcatttaaattaaaaatccttttgagatgctctctgaggtatttttcactactacagagtacttttattaccatatagtgaaaatatctatttgtcaggataagtctatgtcttctgaacttttcttattatttttatgtcaaattgaatgaaataattttttggtacttttctgtaacttactgactataattgaactgtggccaaagaattgatcaggataacaaaaatactttgaaatatcaattgatttatgagttagggagggaatcattgttttatctttatcaattatttaattttgtgtaattaattttcttattttacttgatcctgattagccattttatgagcctatcagtttcttattagagttcttggaatttttgtttagtgaattgatttttttttcttttttttttttatttcaacagaggtttgaggactaggtggtgtttacttacatgaataagttctttagtggtgatttctgagatttaggtgcacccatcagcagagaagtgtattgtacccagtgtgtagtctttcatcccttacccacctctcactttttccctccaagtccccaaagtccattgcatcattcttgtgcctttgcatcctcatagcttagcttccacttatgagtgagaatatattatgtttggttttccattcctgagttactccacttagaataatggtctccaattccatccaggttgatgtgaatgccattgtttcattcctttttatggctgagtagtattccatggtgtatgtgtgtgtgtgtgtgtgtgtgtgtgtgtgtgtgtgtatctcacaatttctttatccacttgttgattgatgggcatgtgggctgcttccatattttttgcaattatgaattttactgctataaacatgcatatgcaagtatctttttcatataatgacttcttttcctctgggtagatacccaatagtgggattgctagatcaaatggtagttctacttttagttctttaaggaatctccacactgttttccgtagtggttgtactagtttacatttttaaaacttccatgtgtgcctaaaagtgttagtgttacatatatgtccatttaatcaaacatatccattttgatgttcaaataataaacattgattttcactatgtcctcaggaaggtgcattaaagtatccctttataatgtgaactcatcaatttctccttattaatttttctaagtacattttaaggctattattattcagttcctgcaactacagaattattatatcttctggataaatttaatcttttgttgtttttattggccaagtttatctctattaattttttgcattaaagatttttatattcaaattacaataacatccttttttcattgatacatgtttattatcagcctttccaccttattattttcagcactttccgattgatttaggtatgccctttaaacaaaaagagagagagagaaatatgtttttatctttttgccaatttctgtatttttgttgaagattgtattcatttaaatttcttctaattactgataaatttaaatgttactgttttcattatatgtgccattatctgtcctattatatttcttgtgtcttccatttatttgaattgattatttttttctctttcattcttttttctaaatataattttggtttgttcaattatattgctgagaagtattgtattgtatgactataaaataatttgtttatccattcacctacggatgaacatttgcattgtttttagttttgtgtatagttattataaacgtgtacgcttgtttttgtgtaaacatatattttcatatttatttgtaaatacataagagtagaattgttaagtcacatagtaattccatgtttacctgtataaggaatttccatactcttttgaaagtattcatactttgtattttatgttttaggaaccatataggagagtttcatttgttctacatttacgccaacacttaatatcatcagtcttttaaaatcatccacaactgatgaatagtgggatttattttattttcgtttgtagtttactgataactgataatactggacaccttttcatgtgtttattgcttcatataggtatattttaacataactgatttgttgaccattcagactgtgcaacttacactttcatattaaaatttactaagtcacagaaagcatgttacaactgcaaacctattccttccttccccttttcatcatttttaattgagatataattgacataccatgaaattcatccttatatcatatcttaacatcagatagtagtgtcttaaaatcaaatagtagtagttcttccatcttgttcttctttttcaaagttcttttaactcatctagatgtattacatttctttataaattttagaatcactttgtatcttttctaaaaagaaaatacaccatagggatttcttatgtgaattgtatcaaatctataaatcacctggcaaagaaataactgacatctaagcaatattgaagctttcatatttttaaaagataattttgtttggtgttctgttttttctagtatgtgcatagttatagatattttttcattaaccatgtttaggttgtattgggttttctgaatctatgctttggtgctttctgtcaattctagaaaattatcaattttctattagaatattgtcataacttctcatcctccttaaacacttattaaaaatgtgttaaaatctcactttaacatggttattttataaacttttcttggtgccttttggtatttaattctgtgtcatacttgcttctatagtccaataattctctcttcatgtgtgactaatggttttctatattcattgcttaaatttaaaaaaattgttactagaagtttcactgagctttctataaaaatgtttagctatattttaactcttgctttgctgatgtgtatttttaaaaatatatttagcatcattatctgatattttacatcttattaaacaaatatcttttatttttgagtattggtttcttttgcctgttatttctgctgtctctcagtcatggtgatacttttccttgtgtactgtttatttacttgtagatgagtttatctttcttggaattttatctatggggattctttgatgcttttgttgcatttgtatttatgtattatgttttatttttaattgtgtatgctgaattgggaccacacaaaccaagtgtggacttatggctcaaatttttagtcaatattaattattttttattagctcagtacaagctcataacaggaataaaaattaaaacatctcaccaatctcttttatgcagcatgggcttttattttttgtcacatttagacaatgcttttgggatctagatttatttagggtctcctttagacccattgtggattttgtttacgccatccaccaaagaaggcattagaacgaaaggtcaaacaaagtctttagcatgtgaataaaacattggtttcatgctttatttttcacgtttccagctttcagtttgtatttggcttttgtggatttatgagatttatttttagtgtttggggttgtgcctttttctaaagccaccaacttatatttgtgttttatttatttgtttggttggttggttttactttggttttctttagttgagggatcaagtggagtatctgtttcacttaatgctggaaaagaaactgccataaatatgttgttctcatcaatgaggctgaaacaagtcttccttgtaagattctaggctaagttaaatctcaatgtaaaaagcgatgtgattcatttgagatatttcctcaaggaaagaaaagatgattggcagctctagttctaggaatttgcaatttctagtcaacttcttttctttacactcactaatatttgaatgaatttccaggttctgctttttctccttttggtctaagatttaccatgtttttatgatgatatatatctatatctagctagctaaataatttcattcattattatggactttgccagcaaaaactaaacttacactctgagatacatcatactgatatatatacacctccataaagccaaaattatgaaatttaaaaaaatgctcaatgtttttgtcgtgtgtataattgtttagtttaattttttgcttttgagtatggaaatgtttaataaggagctgggatttggcgatggctgtgaggcacgttctttttttatttttaatttttttaaaattttacgttaagtaccacggtacacgtgcagaatgtgcaggtttgttacgtgggtatacatgtgccatggtggtttgctgcacttatcaacccgtcatctaggttttaagccctgcatgcattaggtatttgtcctaatgatctcctttcccttgcgccccaccccccaacaggcaccagtgtgtgattttcccctccctgtgtccatgtgttctcattgttcagctcccacttatgagtgagaacatgcagtgtttggttttctgttcttgtgttagtttgctgagaatgatggcttccagcttcatcaatgtccctgccaagaacatgatctcattcttttttatggccacttcgtattccatggtgtgtatatgctacattttcgttatccagtctatcattgatgggcatttgggttggttccaaatctttctaatccattctaatcagtgttctttaactatgtaaagtgattaaggaatagaatgatggtatttctaagaatagtctttggtcacataatatatattttttagacaatactactacctcttttctatgtattaaaatgttagtcctataaacaccaggaaagcattgattaaattaattaccttctaaacctattacatggatactagaggaaaagagaagagaaacttcagtcagtacaaaagcatagatgtcaacttttgtctttttacatccaattttatttcaatatttcacaagtattcactaaattctaaaagttgcaactattacgtaaaatgggacctaatgatatttcaactgcatttactgttatttactttccaactgcattttctgcaatatagtttaactgaaatctctttgattataagcatgcattccacctttctacctcagtgtctttgttcatgccttttaacttttttctaacagcctctaagcctacatattgctttagaattctatctcttattaagccctattcaggtgtcgtttcctccattaaccattcactcaatctctcccactggaaaacactattccctcctgtgtactcatagaacactttttagtagcttcttgtaatcattataccagtatgtaatgtattacattcatttgtgttctgttttcatttctaagtcagactgtatgctttgtcaagttagttcagttttatttgatttttttgttgcagagacatttgaattgaacttatttcataatctttctttaatttggaattccctctccctctggatatccaaactttatccttttttcaaactccaattcaaacctttcctattctgaaagtctttacctcaatttcacacatagaatgttctataaatatcaatgaagccaaggtgattgaatgtattattcaagctttttatttctttactgattatctgtctactttttctatcaactaatgagagagggtgttgaaatgtttggctatgccataagacaaaattacaacatcttagtctaaaaatcttaattgctttatttgcaattctagaattgggcaagacttcattccatcaaatagaaaaagtgtcccaatgagctgggcagaagaggctggttttatagatagaaaagaactaaagaaagaagtaacaaaaaataaaaagcagattggtcatttcaaagttactttgtgaagcaggaacagttgaaaaataactggtagcatcaggtcacttgaggttacattttgttgtcagaattaaagcagaggaaacatcattatcatgctgattgaaactggcctgtttgggaaattaggctgttaacctcttactcctgctttctaggaaggtcaagtaacaactcagtttgggtttggtgacatggaaactcagcatgagtggctccattttgatttttagtctggtccgttgaggcctagtgcagtagcttagttcaaaacaatgacttcctacaatttttatttaaaggctataattgtctgtttgccttttcctactttcagttctatcagttttggcttcatttatttccatacttttttattgtatagatacatacatgcttaggatcattatttcctcttgattagttgacctctttattgttaagaaatgaccttggccgggcatggtggctcacgctgtaatcccagcactttgggaggcctaggtggctggatcacctgaggtcaggagttcgagaccagcctggccaacgtggtaaaacaccgtctctactaaaaatacaaaaattagccgggcatgatggtaagcacctgtaatcccagctacttggaaggatgaggcaggagaattgcttgaacctgggaggcagaggttacagtgaacaaagatcatgccactgcattccagcctgggcgactttatttttggttatattatctcctttgaaatcttttttgtcagatattaatatagccactccatctttctttggattattgtaaacatgttataaatcttactccattgtttttctttttatctatttgtgtatttacatttacgtattacgtatttatatttaaagtatgtttcttataggctgcaaagagttgggtcttgcttttttattcaatctgacagactctgcatattaaatctctagattttaaataatgtatttagctctttcacctttaatgtaatcattgttattgttgcattaaggtctatcatcttgccatacactttccatttcttctgcttttagtttctttaaaattttgtctagtgtgctttatattaaaagagcattttttataataaaatttgctttgttatttgttaattataactggtctttgcattattttgatggttcctttatggcttataatgtatatttttaactaattaaagttgtcctcctgtgatattattttacttcactcttcaaggtaataagctgtaaacaggtcagtatttatgtatgtatacacatacatatatacacatacatatatatacacatgtacatgtatatgtatatgtatatgtatatatatgtacatatatatgaagtgggatatatcagaggagggcaactgtgtgtgtgtgtgtatgtgtgtgtgtatatatatatatatatatatatatatatatatgctctacagtggtatacttctgtttctctatttctgacctttatgccacagttgtcatacattttatgctacatgttataaatcccaaaatatattgttataatttttgcatttaaaagtcagttatttttatttttatttttattttattttattttatttttttgagacagagttttgctctgttgcccaggctggagtgcaatggtgtgatctcggctcactgcaatctccacctcccgagttcaagcgattctcctgcctcagcctccccagtagctgggattacaggtgtgggccaccatgcccagctaatttttctattattagtagagatgggggtttcaccgttatggccaggctggtctcaaactcctgacctcaggtgatccacaagcgtcggcctcccaaagtgctgggattacaggcatgagccactgcacccggcctaaaagtgagttatttttaaacaaatttaaatatagtgtttaaatgtttatatatttacccaggtgactaccaattccagtgttcatcatttctttgtgtagatacagatttccacctagtctcactttttcttctgcttgaagaacatcctttaaattaccttgtactccaggtgtgcaagtagtatattcttccagctctaatgtgtctttattgcactttaatcttttaaatattttattattttctgggcaaaaagttttaggttgacatttcttattctatactgtaaagatgtttactaccttctggtttgcatttttttcaataagaatatgccatcattcttaacttttttcctctgtatacaacgcatcttttctctgtagatgcttttaataatttctctttatgattaattttaatgaatttcattgtgatatgccttggtatagttttcttcatatgtcttacgcttcagtttattgaatttcttgactatctaggttaagtgtttttaacaaatttggaaattttttattattatttcaaatattttttgttgtccactttctcagggattataaatatgggtagattgggctacttgaagttgtccccaaactcactaatatgctgttcaattttttttttaaaagcatgcatttctttgtatgttccatttcagatagttctgctatgcctcaacttcattcttcaaggtagcaagctgtaacaatgctaggactgacgtgtttatttttcatcattcagggatcaatgtccttcatcagtcaatgtccaatgtcctaaaaacttctattttatatattttgtctatatttttagtcatttcatgtgggaggataaatctcatttctgctgcttcatcacgttggaattgtaaacttttaaataaaataaattgtatatttattaaccattttatatgtctctttttggattgtccatttatccattatatatgcttagtttattttgacttctggtatatatgaacatatatatttgtttccttgttgacatactaaaattttgctatattaaagatagcagtctctgttcacacttgtttgaaatatttcctcagctgcttgaattttgttaaaatttgcatatgatgaggcaaaaaactgaagttctaaaacttggcaaactcttctcaaatgctttcttgggtaatttcttccagtgattttattatttagatgtcctgtttctatcaaaaggctaaatgagtatttattatgttttctctttatttatctgagtttaatagagatgagagagatgcatagcacttgtgaggtatggtgagaatttacttatatagtttcaaatagctagccagtttcctagctccgttggttgactaaatcaacatcattaacagtgataccaactaagaattaagttctcattcatttcagggtttatttctgttgaattctgtctttctgttcttatgctaatcttacagtcttttaattataacatgcttcattataactcattttaatatttttaaaagaattttcactctttacttctctctttgaaaatattcttggctcacctgttctattatctttgtttttttcaaattctcccaaaatatgcaactggaattttttaattaaaatttgtttcaacagttataataatttaagaagaattaaaatagtcacaagatgtagctttcatctgagtcagacaatatgcacagtacatttcttttatttctttttttatatatcctagtagaattttatagctttcttaaaatatgccaaatctctctcctgctgcttttatttctaactattgcttattatttgtgtgttttaatttttattgtaaattgtgtcattttctcagtgttattttctaactagcttgttgggataatggaaaggttatgataatagcatatgtagcttttagctggccactgtttattacttattaattatggatatgacttgattgaagacattaagcaactttagtttgaataattatcctcaggacctaacctcatttaatatataataattttaattttttttaagaattatgtgtaagtgctaaatataaaacaaaactcctagaagcaaaattttatggacatagcttctttaaaaacattaatcacagccgggagcagtggctcatgcgtgtaatcccagcactttgggaggccaaggtgggtggatcacctgaggtcaggagttcgagaacagcctggccaacatggtgaaaccccgtctctgctaaaaaagtacaaaaattggctgggtgtggtggcgagtgtctgtaatcccagctactcaggaggctgaagcaggagaatcgcttgaacccagtaggtggagtttgcagtgagcccaattcccaccactgcactccagcctgggcaacaagagaaaaattctgtctcaaaaaaaaaaaaaaaaaaaattatcacaagaactgaaattaagtttagttgtcttataaacatttttttttagaacagatatcactgtgattaccaggccaaaaaaagattaattcatccaacaaacattattgaatgtacactatgtgcccagcactttttttgaagtgttggaaatacagtggtcaaagagtagaagaaaagtctttctttactgaatttagttcagtaaggagagctatatggaaaacatgtaaactaaacataattggtgaaatacataaaatgtcagatggtgagagtttgattccaaaaagtaaagaagagaaataaataaggatgccaggattagagtgaatgtggccaatttagattggaggtaaggaaaggtatcactaggagatcatgtttgaactaagagaaggcaatgtaaggagataagaactatggatatctggggaaaataaaacaaacttaaaaatgtaaatgaatatgaaagcttcttaaaactttacttagggaggtaattatttgttatgtaaagttttgtatcttttcaattgagggagggcctctcagtgtttgagtccagcttgagtcacttctaaggtttaaagcttcagtatacattatctgcagaattaagatcctgcctccttgaggcaggattaagattctgcttcaaggcaggattataggtattgtgataaaatgtgagtgattatgttaagcgaattaatagttttaatgcaaaataatagagtgtaataaaatttatcttgtatttataaaattctttatttccaattaattcattgtgtaccacaagtgaaatggttcagaaagaattacacaagtttaaattcgcacagatcacttctttctttctttctttctttctttattttgagacggagtcttactcagtcgcccaggctggagtgcagtggcgcgatttcagctcactgcaacctctgcctcctgggttcaagcaattctcctgcctcagcctcctgagtagctgggattagccaccacacctgactaatttttgtatttttagtagagatagggtttcaccatgctggtcaggctggtctccaactccttaccttgtgatccgctggcctcggcctcccaaagtgctgggattacaggcttgagccaccatgtccggcccaaataacctcttgtaaaatcccagtctgtcagtgtatcccttttactatattcataaagtcatttaaagatgatctgaaaacctggggccacagcaaacataaattttgagtaaatggcattgcagatcccacctctgcttctccaagtccttctatctattgaatttagtttcctacatcatgagtatatttcttttaagaaggaaaattctaaggaaacattcctatattttaggcttactaaattaaatttaaaaataacataaacttgttaaacttttgtaagtaatgctaaaatgcttggcaaatgggaatgacaaaacaattttaatgaatagcaaaatccgatcacgggaagaccaataaaatgcacaatgaaaacagagcagcctacactgatgatggaagtttttgatctttattaaatcaaaagtagcctctaatttactacagacgatatggtgattcccattttttaatctacctgatgatatgcattgttttgaaagttgaaagcgttcttatatctacctagaacttatatcttatttttgccctcctctgaagtaaattttccaaaaactcttttgtgatatactattgcattctgtaaatacatataaaacaggtgagaggaaggcgagccattaaaatttaacttattttcatctggggctggtggggcacacctgtaatcccagttctttgggaggccaaggcgagtggatcacttgagcctaggagttcaagaccagcctgggcagccatggcaaaacctatctgtacaaataaatacaaaaattagctgggcacggtggcacgcacctgtggtcccagctactcaggaggcggaagtgggaggtctgcttaagcctgggaggcagcggttgcgatgagcagagattgtgccatgtacttcagcctgggtgacagagtgagaccatgtctaaaataaataaaattattctaatttttgccagtgtcgatttttgtttaaaaatcaattaaagaagcatttgtggttcaattttaaatgctataaatagaattttattcaacagcttttattatcataaagacttagaaaatatttggcttcattaaatgccaaattttcatatttacaaaaatagtaaaatataactccttgtatagcagcaataatttacattcctggttttactgaagaatcacatggggagatccatcaggtgcccattctccacagattgtgattgaatgtgggtcggggagagcactggcactttttttttttaaagcttcactcatctagggaacatcggctgggactaagaagatgtttccggtaggcacctttattatacaattatgcagtaataacttgttgtatataatgtagatcagcagcatagaggtcccctgagagtttattaaaaatgcacaatcttaggtcccaccccaggtctactgaatttgaatctgtatgctgacaacactctcaagtgatttgaattaagttagaagttaagaagcattgttgtgggatctacccctcctttggaaggcactattcctgattcctagagataatcaggctatgagagacatgtgaaactgagataaataaaataaaacaaaccaacaaaaacatataatgtcatcttatatatattatttaaatgtaacataagcttttatggactggaatattcattattctatcaatgttttcaggttatataaacaaacatcataatcagctgaaagtttgcttggccatcatggtattgttaatagaaccagaaaagttgcatgcatcagctaagatgtgtgatgcattcctcactatgggaagagtcttgcctacgggaaatacttgaaatctcttggctgcaacacccttcgcccatctttatgacagagaactaggaacaatatactggaaatgctccctctagggacaacactttcaagagctgtttccacttttgctttatgatacaggttcaacgtacctaatctgaaaatccgaaatttgaaatgctccaaatccaaaatgttttgagcaccgacatcataatgccacgcatggaaaattctacacctgaccctatgtgatgggtcacagtcaaaaatgccattaaaactgtttcatgaacaaaattactaaaaatattctatacaattactgtcaggctgtgtgtataaggtatattaaagcatatatgaatttcatgtttagacttaagttttcatccctgagataacacattatgtgtaggtaaatatccctaaattttaaaagaatccaaaaatcggaaacttctgaccccaagcatttcagataagggatattcagcctttagctatttactttcttgctttgcatagcttaccccaccttcttatttttctttcttaggtaggttaatacatttacctacctaagggaaaatttaaaatgggctacttccagattttgctggcctaagactgtctctctcaatgagaatgagcaaaggcactttgaagtagcttatatctatataggataattttctttccttcagttactaatcgttaaagctttgctcaagcttctgagtactatctaaatattccagtaccagaacaatatatgctatctcagtccattcagtaatgaatgactgcattttgaacttttatgtaccaatttttaaatgatgctccaaatacacataaatgaaattctttatttcttacttcaagagtttagtgacaatgacaataaaactataacctggaccacacttgagtcatctgaaaatctttcaaaagtagacttcatcatgaacaaactgcatcagaatttctgagattgaggcctgaatgttaatattttttaatacctcccaagatgttctgatttccagtagcataaagaacattactgagagtagggctgaaaattaatttctaaaacagatagctcagtaggtcatttttttttttcagcattactgtaattattaaaatctcctctggaacttttctagtcagatcttggtctacaaaagaaaactggacatcttggcttattaaaaaacatttcaagagggtattcaaaattaaacttaaacaataatttaactcatctatctgggaacattattcattatatcccattgctttccaaaacttagttgtgtggaatatagagaagacaattttctcctttactcttcatgagtttttagctaagattccctgcaacaaaaggcagattaacaggagaaaaacaagccgggcgcggtggctcacgcctgtaatcccagcactttgggaggccgaggcgggtagatcacgaggtcaggagatcgagaccatcctggctaacacggtgaaacccgtctctactaaaaatacaaaaaaaattagccgggctggtggcgggcgcctgtggtcccagctgctcgggaggctgaggcaggagaatggcgtgaacccggggggcggagcttgcagtgagcccagggggcggagtttgcagtgaacccagggggcggagcttgaagtgagccgagatcgcaccactgcactccagcctggaccacagagcaagactctgtctaaaaaaaaaaaagcaagagaaaaacaaacagaagcttaataacataaatacctcctttgtacatgggatagaaacaagaaaaatgggcagatctctagagtagatctcaaagaattgtcttatacctcagatgcaaacactaccattctctgaaacaaaggcataaggatgtaggaaaggttttgttaagaaagatgaccaggaaaagcaaaacacaagcaaagtttgtcacgcatagtgaagtcgatttcttctccattgattgagtcttcggttatgtagttattcttctcttcctggtgcggaaagagagggagagaaagagagagagagagacccttgaaaacatctatacatttcctttatagacataaatttatcttacacaagggaaacttccagccttgtttctagtattcttcctgtgtctgcagtttctcaaaatatctagctccaaataatcctaagccagagaggcatatttagggtgaaatagtctgagtgcagccttattttggggtgacatgttctgaactctataagaaattaaaacaatctaaatttttggtgagatattttcaaaatttcattatttcttaattctacataatcatcattatttcagtattttattaaattagtggaaaattacatgtgatttaataagtgctttatttccctaacctcaaattatttggggcaatttccagatgtatagtatgaaatcatggagcaatatttgacatttggtgatgtaattaattttatattttacttaaggcttattaaaacagctgttatataacaatttaaacaaatgttcaaaaatcttaattgtacaaaatgattttggcttttttcccccaagcctgagacattctgatatgatgtacagtaccaaacattgatcaaaagctaaaaatgtctccaggcatagttgttatatataaatttgtgtgtgtgtatgtgtgtgtgtgtgtgtgagatatatatatatatatatatatatttttcccccccagggttatggtggctatattgcatcaatgatcttaaaatcagatgaaaagctttttaaatgtggatccgtggttgcacctatcacagacttgaaattgtatggtgagtactttctacagactgacctagtataatgtattgatttgtagaaaacgaaagcccaatttagaatagctcaattgagctcatttatcatatgttattagagcctgttttcagctgtttatctcctccttgattcagctgattttactaaagcatgacaattaaatgtaaaatgaagaaattaatgaaatatgccagtcaaatagtttttagtttcttctcgaatgtctgttttcttgggtcacagcctcagctttctctgaaagataccttgggatgccatctaaggaagaaagcacttaccaggtaactaatttgaaaataacaaagaaagaggagtatttttgttctaaaaaattagttaaatggcttatttagatctatagatacagatatttgtattttcctttataggcagccagtgtgctacataatgttcatggcttgaaagaagaaaatatattaataattcatggaactgctgacagtaagtattatacttgccgctgctgtttgatagggtatgaccttttacaaagggatacatctaaggacttgcttacaggaagccctgtaaaccttctgaagaagggagcagagagtcacacaaagaatcagatacatgatagaaggtgggaaaaaagaattcagagataagaggagaggaggctattcctcaaatggcagcgttgtccaatcaaactccctgtaatgatggaaatactttatcaatgttgctgaaaaagtagccactggccacttgtggccataccttgtttagtgtgactgaggaactgaattgattttatttaattttaatttaaaaaggcacttgtgtctagtgactatggttacagtgttattcagcacacctaaaatggaaaccaacctggaaaacagaaaccaaaaagctgcaagcactgacatgaaattctaatgaggttacccgcttaaatgaacttaaaaactttaaaaaggcactttcatatcatctctcattttttcatcactttaaaccttggaggtggatgtgattgatgttagtagtaataaataatatcattttatatttacatgacactcttagggaccaaagaatctatattttattatcctctgtgatattttacaacagacagctgaatatttatagcttcattcatggatgagaaaaatcaatttcaaaaaggaaacagatttatccaaggccatctggcaagtgagacaagaaagtcaaagtcttgaatcaatatttcctaaatcttgaacttaacttcttcctctttagggtgggttccactgaatgatttgcttcaagggtactatatggaaaaagagagaaagaggaactttacagtggagaaatttgacaaacatcacatcaacagtgacaagtcatgttattactgttattaaatgcccttgatatgatgtagtggggatggcactttacctccatggtttagtactccaagcccatacataacaccagtctaaccatgagaaaaccatcaggcagatccaaatgaggaaaattctatcagatatccagccagcacccctcagaactgttggggtaatcaaaaaaaaaaaaagtctaagaaactctcatagaccagaggaagtttaaaagacatgatgtctaaatataatgtgggattctgaatggaaccctggaacagaaagggtacacaggaaaacaacaataagaacaccaacaagaaaaactagtgcaccccaaataaagtgggtttagttagtggtagtatatgagtcttagtttctatttgtgacaaagtatataataatataagatgttaacaatggggaaactggaggacgggtatccaggaactctgtactatctctgcaactgttctgaaaatgtaaagcaattatagtattaatagtctattaaagaaagaggtagatgatacagtaccagtgttgggtgaaacatgatgaaagagagcgtaaaaattttgagggacatttggatgttgttctaaggtattaagaccttacatatatatcaacagtaataaaaataaatagcaattatgtactcattgtatgtcagaaaatgtgctaaaagcatttaatattatcttatttgtacttcttgcaaacacggaatagtagatgttattactttcatttaacagattgggaaaataaatattaggaaatgatataacttccttaaaagagtagacacaattgattagtaggaaggagatttgaatccatgtattgagccttttattcactgtgccctgaagccttattcatatgaataaattatattcaaggttaaattattgtatgtctacccatcatgctggactaatatattagtgctatttcaaatttctctgtcaatatgttgtagctataaaggtaaatcattgttctatctgactcactcagtcacaggcctggcgcttcacccatctaataaaatacaagcagaggttcagccctggtccctggagaggaaatgcacctgtgaatgtgtgtgagcacacacacacataggcacacacacacaggcacacacatacacataccacacaacccatacgggcctggtgaattataggtgctcagtcatgacactgtaacaccactactattaatattatcttcaaaaattaccagcaaatgaattcaatcacccagtcaaacctgtaatgttcccttttagctatagtaaacagacaaatagcaacaaatatcaatggactttgcattagaaactaagcagaaaaaaaatccaattggaaaaatccttttgcacatttattttcagctgtctccatgcagacaaataagggatcacattacctctgtcattgaccttattaattagcatttctagaagcttacatttatagagcagtttgtacttatgtagcaatgacaaggtcattttcccattaagtgccataggaagatgttgaaaaagatcttgactatctagttttttaataggtttaaatgattgtttgccattttacattctctgctgtgtggtctgattattcagcattctagagttagagcattaaagaggcttaaactattgataaggctgccctaattttgcaacgacaattaaaaatgttagcttaggctgggcgcggtggctcacacctgtagtcccagcactttgggagaccgaggcaggcagctcacgaggtcaggagtttgagaccagcctgaccaacatggtgaaaccccgtctctactagaaatacaaaaattagctgggcatggtggtgcacgcctataatcccagctactcaggaggctgaggcaggagaactgtttgaacctgggaggcagaggttgcagtgagccgagatcgtaccactgcactccagcctgggcaacagagcaagactccatctcaaaaaaaaaaaaaaaaaaggcagcttaaacatgagttacagaaatctgaagatacacaaactacaggaatgaacaccctagacagaatgtgagccaacttctgcagaaagagatttgagtgactgcaccaaatcttcatagctaccaaacccatggctattgggctgcttacttcagaatcttggatcttaggttctggcagaaggaagataaagcaagagtaaccagtatgctctatattaaatagttagtccttgtataatgagatgtgtattctattttctcagtatggggtattcttttctaattttgaataataaagcagaatgccagtatccaactgagactgtgccctagtaatcttcaaaatgaaatagatagctggtttcctgtattaatatccagaaaagacatttgccatattaaaattttttataaattttataaaatttataaaaatatgtgtaccattaggaataataaatactatccagtaaagtaaatataaacaccattctgtagagtaagtaggacttagttgtagctactgttttgcttttttgtttaatagagtgaagctcaaagttttaccattgtatttgtatttaccagctttctacctaaagccagatataaggttttttggttttttttttttttttttttttgagacggagtcttgctctgtcgcccaggctggactgtagtggcacgatctctgctcactgcaagctccccactcccgggttcacgccattctcctgcctcagcctctcgagtagctgggactacaggtgcccgccaccacaccggctaattttttatattttttaatggagatgggatttcaccgagttagccaggatggtctcgatctcctgaccttgtgatcggcccacctcggcctcccaaagtgctgagattacaggcgtgagccaccgtgcccagccagatataagtcttttaaatgtgcaatgtatgtaaaataaaacactgaatctctttgaaaaataatatgaaaaagttctcatacaagcagtgtgtttcttcagatatcataatttgatttcttgcagcaaaagttcatttccaacactcagcagaattaatcaagcacctaataaaagctggagtgaattatactatgcaggtaagctactttcttagaagaacgtgttttcctgctgtgttttttcacttgtgagatacgcaacacagcttctctattattccattctccctactattattttttaatatgttttttagttaccaaagattgtgttctctgttcctgattacaccgagaatgtggatgaactcatgctttacaagtgaattgcatgaatcctttctaaattgtcattttcctctcagacttattcatatcccaaatattgaattcttttaaaagtaacaagtttctacttcccttcttgttccttttatcttttcttccttttgttgttcctttcttccttttcttgttccttttgtcttgttcctttgtctttattattaaatatgagagtttattattaatttatttttaaatatgataatttataattctcataataaatagtggataaaaaatgtttggggaaatattacaagaaaagaagagaggataaaaggccatttgcactaccatttatgtctgtgcattcatacatttaatatatatttatcaaggacattacagtggtcactctgctctatgagtaacaagacatacattacactgtcaaggaggttccagtctgatataagagtcatagaaggaaaaagtaaagtcatttaaatttctcagcattcagaagaaccaaaagttgctcaacctgtctaaaacacaaactaccacgtttaggataatgaaatatgaagctatacagataaacaaatgtcaggtcattccataagcaatgttgaggagtatggagttttattcaaagggcaatgaggcgccatttaaacctttgtactcaggaattaatgggataatatttgtattttttatttgtattttagaaacagtaacaattttgtttacattggaaagggaattgtcaaagtaaataattgcaccagacaatgttaaagaggcaaggaagaccttatgaaaaactactgcaaaggagacaaagactgaactcaatgctctttaaataaagagctggaaagttttctaaactaaatactcctaaaaaggggaggagaggccaagggcctttagtcaaaaagaaactgtccaaagtttagtcaagctgagggcaaggttagtccatctcagtcaacataaacatgaaaaagtctaccttttatggccaacatattctaatttaaataccaaatattaattgacatgattacaattgttttaaaagtttagcatgaataacttagagtagaattaggtttgattttggtcagatattattactcaaagtttccatgacgttagggctcagaaaatgaatgcgagagacaatagcttcttggataatttgaaatcttctttctcctcaatatcttaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatattgaggctcaatgaaacctgacaaagagactgtaatattgtagttgctccagaatgtcaagggcagcttacggagatgtcactggagcagcacgctcagagacagtgaactagcatttgaatacacaagtccaagtctactgtgttgctaggggtgcagaacccgtttctttgtatgagagaggtcaaagggttggtttcctgggagaaattagttttgcattaaagtaggagtagtgcatgttttcttctgttatccccctgtttgttctgtaactagttgctctcattttaatttcactggccaccatcatctttgcatataatgcacaatctatcatctgtcctacagtccctgatctttcatggctgagctgcaatctaacactttactgtacctttataataagtgcaattctttcattgtctattattatgcttaagaaaatattcagttaataaaaaacagagtattttatgtaatttctgtttttaaaaagacattattaaatgggtcaaaggacatatagaaatgtggatttcagcaccttccaaagttcagccagttatcagtagatacaatatctttaaatgaacacacgagtgtatgtctcacaatatatatacacaagtgtgcatatacagttaatgaaactatctttaaatgttattcatgctataaagagtaaacgtttgatgaattagaagagatgctcttttccaagctataatggatgctttgtttaatgagccaaatatgatgaaacattttttccaattcaaattctagctattgctttcctataaatgtttgggttgtgtttggtattgtttttagtggttaatagttttccagttgcatttaattttttgaatatgataccttgtcacatgtaaattagatacttaaatattaaattatagtttctgataaagaaattttgttaacaatgcaatgccactgagtgctattttgctcttttggtggagaaggcttttttcaaaactcttggtccttttacttctttctctcagtgcagaatcaattctcattttcatcgtaaaagcaaatagctggattatttcatttgccagtttctatttagtattccatgcctgcccaattcatctgttactgtttaatttcaattcttctggtgagaattagaaatgaaatattttttattcattggccaaaaagttcacagacagcagtgtttgctatttactttgaattgaaggcacaaaatgcatcaattcctgtgctgtgttgacttgcagtagtaagtaactgagagcataaaataaacctgactgtatgaagtcaatttaagtgatgagaacatttaactttggtgactaaagtcagaatatcttctcacttcacttaagggatcttccagaagatatctaaaagtctgtaataagcttagaagttcagataaatctaggcaggatactgcatttttgtggttttaaaaaagtccttaggacagactgaattatcataacttatggcatcaggaggaaactttaaaatatcaaggaatcactcagtcaccctcctgttttgttgaaggatcaaccccaaattctgggtatttgagtacatgtgaatcatggatttggtattcaactttttccctggatgctttggaatcgtgtcttccatgctccactgggttcaatttaaaataggagaggctttctcttctgaaagatccattttaggtctttttcaagaatagtgaacacattttttaacaaaataagttgtaattttaaaaggaaagttttgcctattttattaagatggaaatttctttttaggctaatttgaaatccaactgaagctttttaaccaatattttaaatttgaaccactagagttttttatgatgcaaatgattatgttgtctgaaaggtgtggttttattgaatgtctatttgagtatcatttaaaaagtatttgccttttactgtcatcatttctcttgttttattattattatcaatgtttatctatttttcaattaatttaatacagtttctaatgtgaaagacatttttctggaacccgttttccccttaaacactaaagagacctcaagtgaaagcatattgcttagtaggaaggtagaaaatgttaatccctgcgattctttgagttttaatgacagggtcattttcagtaaaggaaatgctcaccaacacatagtcaccaactattaaaggaatcatgtgattggattttcccctgtatacatgtacccttggtcataatcccactatttcatacatatttatgcattgctagattttcctaggactccaatagcatgctttccaagtgttattattcccttaatgttaa
